United States Patent 11,252,965 (RNAI INSECTICIDE MATERIALS AND METHODS) - sequence listing, part 2

SEQ ID NO: 144 - DNA, 68360 bp, Aedes aegypti
  misc_feature (16690)..(16830): n is a, c, g, or t
  misc_feature (44382)..(44481): n is a, c, g, or t
  misc_feature (67909)..(68360): n is a, c, g, or t
tgatttctgatttctgatttctgatttctgatttctgatttcggatttctgatttctgattcctgatttctgatttctgaaaatgtttctgcaaatcaaacaataaggcaaataaataatacaatttttactaaaataagtgtgaaaagaacaacaaattttaaattgtcaatgagccatcgtaacagtcatttgattgcatgatatcgttcggagataatccaatcatcatcgtcgatgaaccaattaaacccacaaccagatgatccacctgtgcatcgataattggtagacaaatgtgttcacatgaccagttgctgccaccgatctgattcattgactcaataggctgatagattcatccgtccaatctggtcaaacccttttccctccccaattccggcattttggcaccaattcattaactgttccgatgccattccggtcgattgccgacgatatgtctgaatgagccatcaaactttaaagtcgctcctcggccattgaaacgacgaatggctggcagacggcaaagcatgacagggaaatactgatccattttgggaattaagcgaaaggtagatgaactttcaagccaaaatggggcctcggtacgtctctaattgacctatcaatttgagccaagtcggccaagcagaagtgacgtgtggcgtgatgaccaaaccgtgtcattgcttgatccaaagaatgtgaatcctttgtgagctaggatgtacccattctagaaccacataatttgaaatgattccaacccctaacagtacaacaaacggtggcaatgtcacgacacacaagggcgggctggcagctcgtgaattcaaagtcgagaaaagtaataaacaacacctgagaaatttatgacgttggcgtgacataaaactttgtttatgatttctctcgtctcattctggggctgtttgtcgtattatgtgtcgccttggaatgtgtttgatttttccatctgactgctgtttgttttcggggggtctgggctgctccccgccatgtcgagggaatccttggtttatttctctgttgctgaactaatcataaagcaattccgtgccccaagtactttattatgagttttactaagtcctgttttattcatcataattaccgaaagagagattagtcgggttgggtatttgcaacaaatggaatttgtttgagcgagttatgggaatgcttttctttcacacaaacgacttaggggcatagaagcaattaggttatggagaaatcgtttttctcgtgttctgcattgtttgtggtattgtatttcaaagtgctaatgggcataagaaatcagaaatcagaaatcagagatcagaaatcagaaatcagaaatcagaaatcagaaatcagaaatcagaaatcagaaatcagaaatcagaaatcagaaatcagaaatcagaaatcagaaatcagaaatcagaaatcagaaatcagaaatcagaaatcagaaatcagaaatcagaaatcagaaattagaaattagaaatcagaaatcagaaatcagaaatcagaaatcagaaatcagaaatcagaaatcagaaatcagaaatcagaaatcagaaatcagaaatcagaaatcagaaatcagaaatcagaaatcagaaatcagaaatcagaaatcagaatcagaaatcagaaatcagaaatcagaaatcagaaatcagaaatcagaaatcagaaatcagaaatcagaaatcggaaatcagaaatcagaaatcagaaatcagaaatcagaaatcagaaatcggaaatcagaaatcagaaatcagaaatcagaaatcagaaatcagaaatcagaaatcagaaatcagaaatcagaaatcagaaatcagaaatcagaaatcagaaatcagaaatcagaaatcagaaatcagaaatcagaaatcagaagtcagaaatcagaaatcagaaatcagaaatcagaaatcagaaatcagaaatcagaaatcagaaatcagaaatcagaaatcagaaatcagaaatcagaaatcagaaatcagaaatcagaaatcagaaatcagaaatcagaaatcagaaatcagaaatcagaaatcagaaatcagaaatcagaaatcagaaatcgtttgttaaagatgctttccagcttatgttagagaagctttctagcttctttcagaggagcttttcagttttcgttagaaaaaaattatactgtgagagaagctttccagcttttatttaaaaagctttccagcttctgtaagaaattcataccagcttctgttagagaagctttcctgcctctggtagagcaactattgggcttctgttagaaaaatttcaagcttctattagagaaaatttccagcttttttatagaagctttccagcttctgataaagaaggtttccagctttgatacgagaagcttttaagcttctgttaaagaagttttctagcttcttttgagaagtttctcagcttatcctatagaagctttccagcttctgttagagaagctttccttcctctggtagaaaaacttgtgggcttctgttttagaagcattcatgcttctgttgaagaagccatccagcttctgttaaagaagctttccagctttttctagagaagcttctcagcttatctttacacttcagttgccgcactgttgtattttgtacaacacaggtgagaaaacttcgcttttcgtactcagcatcagcgtggtgcttttggcggtggccaaccgcacgacgaccggaaggttaaagaagctttttatcttatggttgagaagctttgaaccttttatcagagtagctttgaagcctctattatagaagctttgagcatctgttagagaagctttaagcttcttttgaagcctctatttagaagctttgagcatctgttagagaagctttaagcttcttttagagaaactttcagccttctgtttgaaaagctttcaagattttgtatgagaagcttctaagcttctgttagagaagctttcaagctactgttagagaagattcccagctttagttagagaagtttactgtactgcgtattgtaaaaaatttgattaactttaatgattaaaaatgattcccaggttatcaaaattcttaccttggcttttttccctctctttccagatctccacggacaaatccaaacggacatggggccaacgtcttaagctaaccaaaccggccagcgaaaagataagcagctcatcttcccaaatcagcaccagttcgtccagtcaaacctctccatccaagctatccaaccaatcaaattcatcctcttcctcctcctcaacggttaccctcgaagtgctcgattactccgaaatccagcagcaccacgtccagcagcaagtccgctttcaccccgctgctgccaatgccccttccccttttgcgctggcaacgcactcgatgaagtatgccgaatcgacctgggtgtacggcacgatgcgtggaatgccgccgccaatggcggttggaatgccaccgatgccgcatcccgggcaccccctctcacaccatcatgcggccgcagcaacggcgatggttcatcatccggccggaatgttctactcgatgcccggcccgggaccagaggtagcggtcgtcatctgctgctgtccggagtacctgaatggaaccaaaagagacgtgaagaaggcgagcgtctgcaagaagtgcaaggggtcgaggctaccgttggccccgatcggaggaaccatgaggctgacttcaggagcgaccttcctggcaccgccagcgcgagctggaggaacgatgaagttagcgtccacgtacgggaagaagtctcggccatcgatactgggcagcagtggcgatccgtacgactttatgcgaaggtcgagactgagtcagcctgaacaagcaagcaaatctgtgaagactagcattaaggagaagctaaggggacgagccaaaagtacgagtccatcgaaggggcgaagtagatcggataagagggcggtttcgcctacggggagtaagagcagcggaagcagaagtttgagtgcgagtcgaggcggtaacaataagggattcaaggactgctgggttgaacccgaggagattcccttggtcgatgtggaagattctgcagctgctcgtcgatcgatattacggtgtgatattaatccgtatgatttgatctcgctgagtagcgggttgaataatgagttttcaccgacgaacgggacagaagattacgacctgtcggagcattcgcagaagtatgaaaatctactggataccttgtacgctaatcggtataatccggccatcaacaacatagcagcaatatcgggccaaagaatcaaagtgtttgacggagatgcgggaccacctgtctatgacgacgtcgatgagtacgtgtacgatccggtggaggtacagccagacccaaaccaagagaacagagtcgaagtcattccggagcgaccccctcggaccaagcacaaacacgattccgcacccaaagatgaagactgcaagtccctgccttcccagatctcgtccgaagcgacacaaagtgcaataaagtcgattctgaagcgaccgggatcgacggtaagtgctcccacgggtcccccggataaacccagcttcgatactatacgtctaaatcagacgctggtccagcgccttgccaagctgacttccgatgaaaatgtgttctcgaaaaccagctccgttagtgccagaaatgcgaagacaccatccggtaaggatgcaaagcggaactctgcgtcacagttttacttgccaagtccgttgaacggagccggatctgcagctgccttgggatcgcgcaagaaggtccattttttagtcgagaacgaagtcatcgatgacgacaagttctttgctcagttgttgctgtcggagaccgggagcgggagagacccagccaagccgacggtgacgatagtggaggtggagccggagaatggagaggacaagacgactattgtggcctcggctatggaccaaacgagtgaatctgtgatcaagagcttagtgaaccatttggatagtttgcggcatcaacagcgacagcacgtggcggtggaacagcagattgatgagagtttgacgaatggaagtgcgatgcaggaggagtcgggcagtgggaagcaagaaccgaacggcgaagcggtgaaagccgataatggagctgtaaatggcacccttgtcaacggatctagcagtgacggcaattccgacggaggtaagacatcatcaagcaatgtaatgttttattcataaatgggtccatttcttcggggcgattataactgaatcaaatttttttggcgacacgcttcgtggaaggacatttggggacggtgaaaactccgattgaacggtttcgctcgtgttgctaacgagctcgcataaaattctaatttagtgaccgtacgcgtctaatgacgcgtccgaatcgactggacttcatcatagaagaatgagcagctctgcaaatcggaaatcgatttcagatcacgaatttgctattatagcaagggtcaggaattatcgtcggatccattcttccgaagaagtttgatcccattgccaactcacctcgcagcaaagcaacaaattaacccgtagttccggaaatgaaatccttccccggaaaccgaataatgccacattgaatgcaaactacaccccgacataagcctcacgcgaatttctcctgccataaaccgtttgatggttggtttgttttgatttgtttgggaggataacgagggtcacggcaagcttttatgaggcttggactcgacagtctaggtgtgtcgaactcacgtcgtgtgtgggactgggacatggcttagcacttgcaggccaatttgaagaaagcaacaatcaaatcaaatagtatgatggattgagtataatgggttgaaatggtgcaatttggtacgtgttgcaaattgaaatcgaatagggggtaattcaaacccgttccgttccggttaaggaggttttgttcatgttcacactgaagcgattagagcatatagagacattgaaggaattttatgtggaaactagcaatttaacgctggtctttgaaacctatgctatcattaagtagaactggtatatttaggtcaacctaaacaagagctcatacatcttcaatactttaaatgtttcatttgaatacaaaatactatacttattagcaaaatcaaggtaattaccaactttaagattcgtcgaatctaccaaatcgagcattaacctgatcacaattacggctcctcataaccaaaaagcacttcagtgcgtccatgttgagatcggtaaaatttcattaccacggccgttctccgtcataacccgcaagttcattatgtgaagcttgcaagacagcaaccttcctcttcaatatattttcttctttctctctctcttttcccgagagtgacccattcattgtacagttattatcattgtcgtttttattaacaccactaccgggccatcttcgccatcttcggacggtacctagtttgtacggcttgctttccttttcgctttgattgcactgcgtggagagggtttggggtcatcatcgatggaaatacagtccacctgcaatgaggagccatttctcgagtgaatatgaataatttcaaagaaagttccatagctgatttaaaacatatttgagaaatgtttcacttgatttcgtgtagtttttattttgggatgaagatgaaaaaaaatgatgattcataattgacgtctcactgtacagaaattttgcttgcggaagtaacaatcagggaaagcagccctggcattatcattattgggctcaagacttcttttattatatggtctcgtgggtgatagacggtggagagatgctaccgttcggctgtctttcaggttattgcatccgagaagtaagcattttttttatcggttttcgagaaaataaatggaaatagggtaggtgtaccagttatggacatagtggttccctatttcgccatacatgataactttaacgttttcaattttttttaaatttttgtgtgttgtagaagttagatttaagatatttcttgatgctaaaacattcaaaaagattgaaaatgtgaaagttgtcaaaattcacatatggccaaatagggaaaccactatggccataactggtacacttccctagatgtcaatggaaaggcggcaaaaattgcgctgaaactacaatataaagtcgagcagaggcgagcttgtagtcaatcctatagtgtatcacacttccaacctgatctttatcacgacatttttgaaatccaatttaaattgctatgttctgatttgcagaaatcggatattaaaagcttataatgctatcaacaaaagatagtagactaaaaagagtttttttataactctcttttgaagaagtaaagaagaatctaaaaaatctcaaagcttgccattaagaatcacctataacaacacatacatgttttcaacctaagtcgagaggttagagtaagagattgaaagacgatgttatcttgccaatggtttatttcttaatggttgtcgttttgtcattttgtcatgtcaaagcctacttaatttagaaacattcaccacagcctactacaactcggccatcctgacattctcgatgtcctcatcgagacaatctacagttgagctatcatcatcaatccatttcctcaaattttgtggtgaacataccgcgttaaaaggaacacttgaaatctgaaacccttcaatatcaactacaacatatcgatcgtttggcaaaattttggaaattctatatggacctttaaattttggggataatttttgagagttttaatacaacaaaatctccctgtttataacttgttgtatttgttctctttctatctgttattttcttgttataaatttgcattttcaaattgttttgttgagccttttgtcgtatttctaaaatattttcattttcactcgatggttgtcgattccgaacaaaagattctaaattaaaattggcattatttaattcattttgcaattgaccaaacaataacatactaggataattacaaattgatttatttaacgtgttattgaatataaactctatttttggcaatagcttgtcccaactacaattagtttcattacttagtttggccagcattggagtcaatgttttattcattctttcaacctgaccattagcttgtggagtacgtattgcagttttaacatgctcaatacaattaaaatgtaagaaatcttgaaattttttagaagtaaatccggagccacaatcagttattaatctcactggtttactgtaaaaacacatataattatctaaatgttgtattatttcatcagaattagtagttttggttggaaaaaatttcgtaaattttgtaaaggcatcagtaataacaagaatatatttgaatctattgattgattctaattttataggcccataatgatctgaatgaaccatatataacggaacattacctttttctatgattttcaaaaagccttccttttttcctatagggttgtagaaaatgcatgacaaacaattcttaatgtgcttctttacatattttctcatacatgaaaaccaaaaattcttctttatttcaactattgttttttctattcctatatgtccacagttatcatggtacatcctcaaaatattatcaatcatatttttgggaacaactaataaattcttgcaattatctctcctaaataaaataccatctagtaataagaaatttggaaaagaagaagtttctaatatttgttttatatttttcaatttagaatcttgttcttgtgctaaaataatattgcgttctatttgagattcatcaattattccaataattttttctctaattttctccctatgttgattattattacctttcttagtcatatgcatccgacttaacgcatcaacgtgtttcattttttcctcctttctgtattctaattcaaaattatagttttctaaaaataaggcccatctatttattttaggattcattattttttcttcaaagtttgaaccaatgcattacagtcagtgaaaatgttgaagctctttccagctaaatatacatggaatcttttaatagcatgaatcacagctaaggtttctaattcgaaactgtgaagttttgactcatactcatcagttttcttgctaaagaaactaaccggatgaaatttactatctgactgcttttgtagtaaaatggcaccaaacccaaatgaactagcgtcacagtgaagctcagtatcagcatgaggatcaaaaatagccagaattggagctgaaaccaatttctctttcaaaagattgaatgcagcaatttgttttttttttttttttcaaaatggaatactgagtctttttgaagtaaactatataatggtctggcaataacagcaaaattttggataaactttctgaaataactcatcaaaccaagaaacctatgaacttgtttactattttgagggattggaaaatgtttgactgtttctatgtgtgagttattgggtttcctgcctttattattgattgtataaccaagataatctatttcattgaacaaaaatttacatttctctaaattaagttctaataaattttgacttaatatttcaaaaacctgttgtaatacttcaaactgttcttcagtagacttggttgcaattagaatatcatcgaagtatacgcataatttcccttctttaatgagtttttgacaaattttatttataaaacgttgaaatacagcaggagcattgcataaaccaaaaggtactcgtagatattcaaattgaccactaggtgttacaaaagaagtaaatttagtgcactcttttgatattttgatttgatggaagccagattgaaaaatagtttttgtctttcagattatcaaataaatcctctataacaggaagcggaaaattatcacgaacagtacctttattcaattttctgtaatcaacgcaaagccttttctttggaattagaactattgtactagcaaaaggtgaattgctctctttaataatacctgattccaaaagttctttgattttttcatcaactttacgttttcgttcaaatgacaacctacgaggtttataatgaaaaggttctcctatttttaaatcaattaacatctcatattcaacttttggtttagacggtctcatataatctacatacagggttcgaaaaatttctaaaaatgttgccaaatgatcttctgatatattttcaaattttcatttatgttggagttaatattatacaaagtatttctatgtaccttattttcagggttttcaggtttcaaatgatcaggatcaactgagtaaattttaatatcattctgtattatcgtccgaatgctgggcttcatgatgacatctcgtccaataattgcatcgatgaggtttagaacattatccggaactacatagaagtcaatgctgaaaacaatattttgaataagaattttgttggtgaatatcctaaaatcttgagtcgtttcccaccgatacctcgaaaacttttgttataatttatctttttaacatctttagcatttatcaaacctcgacgtatcagtgagatagggcttcctgtgtcaaaaagtgcttttaagttagtacaattattgattagcctaaactttaccaaaccgtcacatttgaattgtccgtcatattgttttgaatcctggtcgtccaaagcatgtatagtctcgtcagttgatttgattggcttttctccaaatttttttcgtggttccataaatttcatctggactggcttagctcctcgataagttctgcaatctgctgcaaaatgtccgggttggttgcacgcaaaacaaagctttgccgtcttcctcattagtgctggattaaaccgtatcaatcgaaatgcttgtactacttcattttcggtttggaaattttgcattctggcttggtttcggagaatttgatcttcaatgccttctaccaagtattcaactagttctttctccggtaaattgagcttccgtgcaagtaaacgctttgactggtaatattcttcaaacggttctcttcctgaccaggttggcctagcaagttggtttcgcagttcgtatactcatttaatctctcagaatagtagcgcaatgatcgtaaatatagttgttgtgaaggaaagtaacgattattgagtttagcctgatttgctgttgaaaagaaatcgctgaagaaatttctcgccgattccttgcagaaatgttttacagcggctctcatttgaactgatatttcttttcaactgcgcactgcgatcagaaaaaaaaacgctttcttgatcgattccttgcaggattttcccatgcatcgagataggccgagaaattacttgtcagcagcgaatcaggctttaagctaggtatgttgttccgctcaagaaaagtaaaaatttctgctcatgaaatggtcaagaaacttcctacagtgagctccatttgaaatgacatttcttttcaactgcgtactgcgatcaaaggaaaatgcttttcttgagcatttcttgcaagaaatttcccacgcatcgagataggcgattacttttctgttgaagtgcatacttcgctttaatgagaaaaatgatttcatcgtagtaaccaacggcatgcttgtaatagtagtttacggaacaagttgcagaatgatgatttttacagcacgagtcataaatttatcctacgaggcttgccgagtaggataattgcgacgagtgctgtgaaaatcgaaaaacattttttgcaatttcgtagaagaccacttgagggtaccaggaattatatcggattgcattcaccattaatttacaaattctgaaaaattgttgtgttatgattcataacgcaattcaaaacatttgcgtaatgagaaagcgttgcgtaatggatcattacagcactggtttcagttgcgtaatgactattcccgcactgcatacttcagtgcaggaaagtaggccgtttcatgacagattggcgtgatgaaaaacagcctattacgatgataaattgcaaaaaaaaataatgcctccaccatggggctctgcactgttttgattttgcaagggattttggcgtttactggaatctttttttcatggtagagtgaaagagagaggatgttttttttgtgccgaatcccattgttacactgtatctttagttgcgttatacttttaattttgttcctattgttgcggtatctattattttcttatgggatcctacatgataagaacacttcatcgcaacttttggtacgaatgagaaaagtttaaacagttttggtggaattgtatgaatttttaagcaatttgaaccatgttttcgacaatttcgtgtacgcacaagctaaaacgttgattgttctgttgttaatctaatgaaatcaggataagtgcaaccatagaagcacccacaactaatggatctctttccgtagagaaaaatgacctttggccgtttcgaaggaaattgattagggagtctagaaaaaaaaaatgtttgaatacactgttgccaaaaaaattattattatcatctttattgacgagactttcagaatgaagaaacgaatatacttattttcaaatttaataattttcaatccattgtttgtcgaatgagtattatcagatattttacagtcgaaaacgctcaactcccctagatgatttaagccaatcttcagaaattgcgttttcaagttaaaaagtccgaattttcaataaatcttggattttgacatattgttttttgttcaattaaaagttaagatattttaggttgactcgtctcagtcaaataaaagacaaggataaaataacagcactggaacggaatgatccatgtgtttgtttgacccaagtttttcgacaaaatgttttggaataaatataagttgagttttattctttgatgtactgtaatgtaatggcacttaacactagactctagagccaggccattcggggaaaatcaggagaaagataaaaagatcgttaacaacaatggaacattctcagcaacgttctaacgattttaccaatctcccgatatggaacggttgtccctgtttcttcatttgcaaaaacatcaaaaattttcatctaatgtgttaatcattcctgaataatgaatctgaattaccgtaccggggtaacattgagcagcttttttcaataatttttaaaagtttcattcgacaatgcaaatgctgcaagtttcatatttttttaaaaaagtactggcgtgtatagcttgtaactgtatattgtattttgttttctcattgttttgagcatgttcaaacaaatattcaatgtgattttattaaatggctgttgagagattacattgatcatgcatgtaaaaaatattcgataacattgaaaaagtcgttaggcgtgaaactgaatatgaaggctaaactctttccgtttcagctattttaaaattaaaaacttcgtgttacacaaaaatgtagaaaatttcctgaaaaaaatataaatattcatagtaattcctataattcaacaaattgaacatatttttcaaaattttgactacgggatcgtttattttcagtgaaaacatcattttcgttacttatatcatttttttcatagtgattcctatacaaatttggaagggcttgtccggtcccagttttcatacaaaaggcctcattttttatgcttttaaattgaacgaacagatttttttggatagaagcaccagttttttgccatagtggattaaacatcattctacacagcatatgagcataactattttgtgttcagcagaactcattcacatgatagagtaacattctttggttcgtccttagttattaggccagagtcttccttatttgacaaccctcatgagaaatcaatgtgattggctagtttcagaaccgaagtttaaaaatggctgaaactgattctggtggcctacgcagcaaaaaaagtgaattatcacgtcattttagaattttagatgcacatcatttgagtcacaaatattatgtaatagtacctttcaattgaaactgatttggatacagatatttaaaggatctgggagggtgaaaacaactaataaaagtcgatgttatttaaaaagtatgtaaaaatgtagcatgctggtttttcaatccttattttttgttatatacatttattttgtgcaaatctaagttttttataacttaatcattacaatttaaccacctgatatatctaaacaagagaaacgtacagtattggacaacttatttgcaactttttcgattttccatacaaaatgatgaactttaaagggttatatctgagtcatttatggacagatttgaatgaaattatcacagttcttcagaaataactcgaatttcaacaatatttttcagtgtttttccaatcacgagttcaaaagatgtaacggtttgactaaagtgaattttttggcgattgttttataattgagataagcaaagttgtagattttgacgagatgaacaagcttgcttaaggcagtttttgtgtaaagctatcagaatttgagaaaaatagttttgattttttgtcgaatattttacttttattataacgtcacggtgccctgacagaccgttattatgtaaaaaaattgtccatcaaatcagagtacagggatcgattcctgaggtaattctgcaactctaggccaacttttaaaaattccctaggaggaatctcgagaaatcttgatttgaagtttttgactagaaaattcattacaatccatattgaaataacataaaaccactgaacaaacctacaaaaacgctcgaataagttgatcaaactgtgctcaactactatataatttttacctttgttatatttagatatattgataactaacttaacttattagagtcgcttaggtacgtttttacaaggcttgaacccgtaagcttagtttaatagaataaaatataaaaaagaaaatccaacatgatattgatgttaaactcgataaacgagaatcactcaatgctgaatattatttattaacagctttttttagactttcacaccaagtgaccagcccactgaagtctgccgtatttattttgcttaacacaatttgcttctttgtacatctggtactactcttgatgtttacgtctagctttccaccgagtattgccctcagcattttacgtaaacattatcctgttctacattctcgaccacaacaagattttacttatatggaaaacatgattgtcatatgtcacaagtattcgaagatttacaaagtatttaactacttcaaacaaatccatattaagtactagttaattattctatttaatgatttctaggtcacgttcgactaaataacgaagatctagctgtggcaggtaatattatagactcaaaaagaacatggaaacatcttaacataaacagggaaagctgaataaacttataaatcaagtgtaacaattgtaggcgaggtgcccattttttttataaaattacatggaatgaaaaggagatgagttttcgaatttactgttcaatattgcgttttgtcgcagacgatgacttgattggaatcgatcgcaatgcagtagggtagaagctccggttttggccatacgcctgttgtagccatagtggattatacactgttttacatagccaatcagcatggagctttttgtgttcagtagatcacattcacatgatagagctaaattcatttactcgtccaaatagacctgaaatccactctcataagaaatcaatgcgattggccaatttaggaagcgaagttaaatctctggccgaaactggttctggtggcctatattgaccaacgagattttcaaggcaacaaaatggttttagctcagtttagatattttacatacataatatacactcccgtgcaaaagtttgggttcaccccctcaaaaacatacaaaagtgttctgtccatatctccgtgattacaagtccaattcaaaatctttaagccgcattcgaaaggcaaagagttattcttacttcgtatgtttttttccaaaaacatttttttagttttgtgtactaaattttcacttaaagttgtaacatttttcaaaaaacacactgaaaaatcatatataattgggtcgaccaaaattttaaatcaaagtgtcattagaatcgtaatcttatattatttgatgagacactacggaatttcggcgaaaaaatctggaaagtattcaaaatcaatgaaacagttagtcaagtcatcgtgcaaaagtttgggttcacccctcagtatgatgcaaatcgtgcaaaagtttgggttcatctgagccacacgcacataatttttgtcaatatctctgccatttttcaaccgattttaatagtttaaagcttttttgagcgcaaataatggcgcgtacatgatgggtttgagatttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatattaagtacatattcagtactcaaggtcaaaggaatgttttggaaaaatacattcgaagtaagaataacccttgccctttggaatgcgggcataaagagtttgaattggacgtgtaatcacagagatatggactgaacacttttgaatgttctttagggggtgaacccaaacttatgcacgggagtgtagattgaaagcttgcatttgacatatttgtagtataaacacggcttcccatatattttttatcgacattttctcttaggctcgccaaaaccggtgcttaccctagagtaatttcaaagagggacaactaggagcttgtaatgccattaactctacttaaacgtatgtgattgcatgtagagaaatgagcaggtttagttgtgttggtgctgaggtagtgcttgatgggaatgtagttgaagttattgaagaggcatagaacacttgtgacgtgtaatgatgatatttcccgtgttgtaaaacatgtgtactggctgcgaatatcttcttttatgaattacgcaaccagcctagggacccgcaactttcaaagggaaacgacattactacactgttgctttataaaggcttatctgacttcatagatccattctttccttaacaactttgcacaaaacaccttgcgaccctttatcgtacaatactgaaaagtgtttcgaaaagtaaatcagctttcaatattaatgcaaagagagcaacgatgaatgaaagcatgcccaaatgaaacatcattgtcaatttgccctgtatataacgaagattcttggctctctaaccacatttatttaggaatatgagcgaagactatgaggagaataaaatacggcaaacttcagtagactggtcatttagtgtgaaatccggaagaaaagttacatcaatcaggtgaaggtcagtggccccgtggaagacatctccgttagttcattctgacgttgacgtgagcgtgccagaataaccaaatcattccacatttggaacaaacgtttgatacttgctctaatctaaatagtcgatcaatcagtaatggcatatcttctgactattattatgctacatttattctatttgtttttcgaaataacaataacaatgttaattgtgaatcgtgttgttttacctttcaatctattttacatagaacacaacaatcaatagaactcagaccagtgaactatcaaaacataacatacttaagtcactccggtaataagttagttgtcagtttttctaattataacaacggttgcaattgtatactagttgagagcagtttggccatttattgagcgattttgtagtttttttcagtgctattgcgtaaattttatatggtttatatcgaaatttttagtcaaaatcaacatttctcgtgattcttcctagagatttttttgaaaaattggcccagaggtgcataaggaccttaggaatcgatacgtgtactcagatttaatggaaataaatttttacatgataacggtctgtcggggcaccgtgaacgttataacttataaactcgtgcttggaaatttttttcaaaaatatatgataaaatttaagttatttcggatgttctgtgaaaatttcattcaaatcggtcgctaaataactgagatttagcttaccaaatttgtcattttttatgaaaaatcgaaaaagttgcaaatattttgtccaatactgtgtacggattacggaacgagatatcttgagaacggaaaaaagtgtttattatatttgtcttgaattgagttattcaaattaatcatcaaaaacgaaaaggtttggttttataagtatacttaacgaatgatatactgtggatctcctgtattctttagcactaacaatacattttaattaagtaattgttcgaacatcgcgatgaagcagcttatttctaatttttgtgcactgagagtttacacggtgacacgctctaaatcatacttttgccagcaatattaaacaatttcatattacaccattcacggtaatttctcatcttattttcatcgtttagcgccaaaacccgaatgacatgtgtgaaaaaatgtaattggagttatatgctttgaaatgagttcaggttcaattagatgtgtgtcggcatgtgatatagcaagcgttatgtacctacgcaccaagttgatattaatagtatgttacatcgcccatttcgaaaatgactgcaagatttcacttggcgtatttacagtacatgcagtatttttcatgtatttttttttaaatattttttcttaggctggccaaaaccagtgcttctaccctacttcatgttttggccatggaaaacagtgaattgtgaaattcaccattcgcataagttatcaactcttagccaaaaattaagtatgaaatataagagaacgtttgttaatttattgcttgactggttttccttcttctgtcttcttatgaaacacccaaacaatattcacaagaaatccttgtcgttgatctttcataagagtttcttatacccattcatattatgattgcaattagcgattgaagttcacaagattttcttaagagtcccatcagcttatttatatgtatttattccattagaaatacgtatgaaattcttacgtgtttttttatacgaatgcaacccgttttcacaagtgttactaatcattgtcatacacacgtatggagttgttacgaaaatcgtacttcattagattgtcttatgtaagccaatgatcaatgcgtatgattaccaaaaagagtttgttgagaaattacagttaactctcccttactcgatatagaagggaccatcgagttagggaggtatcgagttacagaacacaaaatcagtgcaattgctatccaagggaccatcgagttagtcatgaaaaccaactgatcgcgcacgaatggtcccattggttacgttgtgatttaattagtaatgaaacaagagcgatcgatttgccgtcctgccatagcgaaggcgtcataactagggggagatcccccagtacttaagccactaaattaataattcgaaaaatattgcttttacgtgctcgtgttacccgtttatgataaatattgtcatttttatagtgtacaaaaataaattcgaaaatataaataggtatgaattttgatattggattttgattatgtattttagtaccaaaatgatcgatcttgaaagatggcatccaataccggacacgatctggaaatgcctcgaattctgtaaatttgagcatcattgaatgtttttactatacgaattactataggaatattatatattgccaattcaatgcaacatttacaagaacaatttgagtttttcttaatttgcaagatgtccatcaaaaacttctttcatatatgatgaaaaatagcacattttacgatgttgttctgattgttcattcttcttaatttcattgcatttttgatgccatgatcaacgaaaaccatgaaaaatgaatatattaagaaacactggtgcaataattacaaagatatcatatagcaaatcaagctgtccgaaactggaggacagaaggtgcttaacaaaaattgaaatttgtccatattttgttaaattatggtacaaaatacattcatactatcaaattaggattatgttcgatcatacttgcgtgatccaaagtattttttcatattcaaaaaaattaataaataggctcaaaattaaggcgatacctcaatttttttaagattttcaaacttttctacttttaaaaaagggcatacatatttcaaggatatatggtcggggttctgctaaaccgcaccaagtaccaaaatcattattttgagatatttaactttaaaattcactcacctgcgatgagatcgcgaatgactcttttcaaaaattttccgctaacaaatgattaagaggttccaataagtaagtcaagatagaatatattttccatgtaattagaattaatttcaaattaaaatgcacttagttcactctggctgaacaaaagtggaagaaaatggttttcagttcggtttggctgaatgtgtttcatgattttcagcaatacaagaaaaaaataaagacatatggtttgtatcatcgccatgcatgtttcaaatgtttatacactacgaatgagaaggatttggaattttccatggaactggtcaacaatgtaatgctggggacctatttgaataataaattggtacaaggcatccttaacgtattctatctctctctctctctcatagtggattacctattttaatagaaataatgttaaatcaaagtccacacgcgttcaaagattcaaaagagacaacaatgatgtagttaaaaaatttgatgatcgaacaatatcattattttgttctgccagagcgcaccaagttacttgtatttagagaaccttggctgaacaagaacgattatttacgtgacatggataccaggactggcacgaaatccattattcacctccgatggtatgaaattctcattgtttataaaactgcttctgatctatagttcaaaaatagtcacataagctgaaagttgattgatttttatgactgtctgctagaggcaacgtaaaaaaaaatattagtcgcgattcgaactcgtgtccttcgagtggtgatcgggcgtgctagctctcggtcgtttcgaactgttgaattgagagctaaaaactagaaacaacttatgcgtattctgatcaatgaggcttgatggtgaaaacgtcattttctgaacagctaaagcgtaccatgtgctaccaactcattcaaacaaaatcaaactaaaatgtcttgttatttcattacggctcctgcatggatccatcaacatgttatataacaagcaaaggctagcgtttagtgcatgttgataccttttcttcatacaaaaacacgatgttcatataaatggtacttggtgcggtgtggctgaacaaaatttgaatgaaaatacatcagcaccaccgaaacaatagtttattttacatagccgttcgcttacattacatgctaaaatccgatggtgttggtcctgtatgttgtccggaatggccagtttgcaatgttttaggaagaattaaaaaaaaaaaacggtttggataagaacattaaataacctccaatgtcaagcttaggtttatggttcgctttggttggctacattttcagtttcacatatcctaccagagaaaaattttgaatttacacaacgagggatgatttaaattattcgatatttgtaatgtggaaaggttatgataatctgaatccttttgtgtaaataactcatttttggaaaaattggcacttggtgctgtttggcagaaccccgaccatattattctacgcaaacattggcctccattatagctttcttttcttctaatacaccatcttgattggaccatgatttctcaatttttcgactttccggtattgggtgctgtccggtactgggggatctccccctactattttatttatctaaagtgcaatacagttgatgagcatacaggtgacagtgtattggtgtatatgtagatggtttgaccgaacaacaacttttactatggttgtctaactcgatatcgagatacccaatatcgagtaagggagagttaactgtagattggtttatattataagtattattccataagtatgttgtggatttttataagattcggaaattgaaaaacaaactacttttcatgtcgttattccataagaacatcatgtgtacctcacactttccgttttctcagtgaatgtaggtgcgaacttaggaacaactaccctaccacttgtatctcttctgatcgtagggtgctttacagttcacttgtctcacttgtagaatgaaaacgacaaattttccaaccaatttccattccaaccagagagaaatcttgaagaaccttttatcgcagcacccgctgcgaaattttccaactgattccgtccaacttcggaacaatcaggaaaaaaattcctccgcaaaactggagccagtttcgaagacacacacccgcgcacacaaacacactcacacataccagggaatgaactcataatctttatggcagccatcgcgcacagtttatattccgttcaattcgattattttatagactttattacgattcacttgttcgttaccatcgtagcacccgaagagcaccattgcttcgaaactggccggaagctccctatgcgagggaaaacaagaaaaaaaatggtgacatccccgttggctgttcttccacccctctctcttcgaaccagtcgacagtaatctaatccgaaagttttgattcgaatttctgttccaattctttctccgtttttttttcttctattcaatttataccggggtgtcttttgcgtggcttggtcggtttgttccacctgagagacggaatttcgcttttctttttctgttccctgtgtttttttttctctgcagcaaaagcggtgcaaattcacaccggttagttggaagagacaattgacttcgattggcgcattccagtgggatgtcgattcgattggatggcagtttcgattatggcgagttgggtgttcttcaccggttgaagaggcggtttgcagttctttcttttacaagtgaatttatttccagtacagtgaaacctcattctacgaatctttttattaaagtatgagacacaccaagcaaagaaaaacctgagatttatcaaaaaatgggcttttcgcaaactgtttgtctagctggcgtacgaggggtccaccaatttgagaaaacttacaagaccactctctacccaagtaacattggtagctgaatagcagcttattcagcctgaaatgagctgtataagcagtcttttagctgaataagctgttattcggctactaatgttacttgagtagtattagcatacacttgcgatcagtgacataaaattggaattctaacgatgggtgccgatggcggcctggtttcagcgggaattgatctaaagctatttttgatgtttgcaattcattctcaaaaaaaaaaaacaacatatgatttctattggattccatcattcatttcttcaattcatgattgtaacccttacgaagctctttattccttcagttcaatcagaaccacaggtgcgagagctttattaaatatttcatatggttcaatctcgtagctggcagaacaaagccaacgcatagagattccatatttagcattccagtgaaattctgtctctgcagagcgaaggttaccgaccaataagaaagccgattttctggaaattctcacccttggacttgcaaactgctgcccaatctgctcaagtgttcggttgaatccccatattgctaatcaaatgcaccggacgaagtgaatttcaccgaaatttgctactttcccccacgagtcgattgagtccggcctgcgaaatgctccgtttcacattcagcccacttgattagtgacgatcggtttcaaggctaattgactttcagttcccttaaccctctgatacccaaatttttattttcgatctaaacatcatttttagttatctaaaatcgttctaaacacattttggacaatgatttatttttattcacaaatctatggatttcggtttttgatttttattatttttatttatttatttataacatccctacccttttttattttttcttgaagcctcttctagctactgatttttggcaataataaaaattaaaatttttacgctaattttaaaaatataaaatttttaatatttttctggaaatatttttattttccgtttatttaacggaaaaacaggttcaaaattatttgaataccaccaagctcttcttttgtgataggttgatcgtagaaaaatataaaaggtacgattttttatatcacacgttaaatgaaccccgggtatttgtaggttatataagaatacaatttttcaaacaattttcaaaaatacaaaaaagtttcaaaagtcataaaaaacttttcttatatgcgtgttatgggtcaaggttttagccaaaaataaaatcattttgatttccgagctacgaaaaaatacacaaaattccaaagtgtaccccgctttccattgtagagtggagctgctgattaaaagtgttagaaattttctgacgatgggcattttcagacgagttatctgtttctgggttcaagccatccggtcaacctacgcattgagttcgatcatttgattctttttctagttcagcacctacacaggctttgttgcccattgactgcggatcatctccattcaaggaacgatttcagcacatactgaggctactcagtacaagggtggacatcctttttcagttacagttggctcatttcattctcattagatgatttcgagtaacattttatactcttgggctatcgaaagcaagtggaacaagtgtggacgagacttgaattgagacaacttaattgtcattgagaaaggaaattttagttattggaacattggaacattctggtttgttccgccgttcatggatactatttggtagatactaagcactactacataatagaatcaacaatagataagagttgataagtcagccctgtcgtcctgcttagtcgcgctcagtcggcgactaagaaattttctcaaatttctctagaactttttacccaaacccataaaaaaaatgttggtaatgtgatagagccttgcaaaatcaacaacaatctaacgccccgtaagacatccctcaattttccaacctctaccagcgctccggaataattttacctaaaattttgcgagatcaacgccttggagtaattggatcttattttatttaggtgaggtatatcttgacatcaattgtacattctaggcttatcaacgccctattaggtacacattaatgccctgtgtcgtttgaaaattataagctgtatcaaagccctggggtaatttgaacttgtctcatatacatcaattgcatctcaactccctgtaggacatcattaaaaaaaatcaaattatttaaacgttctggattaatttgaacttatcctttgcaaatcaggtgtatattacgccctgtgtgaatagaaattccaagctctattacgccctggaaaaaatagcataactctatgtcaggtgcatcttaacgtcctgtagaacatcaatggtaatttccaaactgtatcaacacacttaagtaatttaacctcattacatgtagatcaggtatatctcaacggagtatcagcgcattggagtaattttacttttttcccttgtagatccgttgcatcttaacgccttgaaggacattaattcaataatcaagctaattttaacttatcttatgcagaccgagtgcatctttacgccctgtacgacataaatttaatatttcaagctatatcgatggtctagagttatttgaccttctcccatgtaagtcaggtgtaaatcaatgccctgtggaacatcaacaacaattgacaagatgtataaacgccctagactatttagactattgtcttacttagatcaggtgcactttaatgccctgtatcgattggaaattctaagctgtatcaatgccctggagaaatttgaatttatttcttttatatcagctgcatcttaacgccctgtaagaaattaataaaaatttaaacacatataaacgccctggaataatttaagctcaccctatgtaaatcaggtacatctaacgccttctcttacctcaatagaaattccaaaatctatcaacgccttggagaatgttgacataatcctatgtcgatcagattcaactcaatatcctatagggcatcaattgttaactccaagctgtatcaacaccctgtataatgttatcttttcccatgtagatcagttgcatattaacgccctgtagaacttctatcgaaaattcaagcagtattcgcttcctggagtaatttgacctcatctttggtagacctttacgccctgtatggaattataaaatttcaagtttatcaacgccctagataaatttgaccttatcctatgtacataagatgcatctttacgccctgtatgacaacactcgaaattttggtgatgaaccagccacgggctgaaaatctccctaataaagctaattaataataataataacaatcgaaatggtcaagatatatacccgccctgattttgtcccatatagatcatcttaacgcctcgtaagacatcaattgcatattctgagcaatatcaacgccctggagtatatcgaacttatcctatgtagatcaggtacatctcaacgcactctacgacattaattgaaaattccaagctttatcaacaccctgcagtaattggttggtgttcattcagactggaccaagtgcttttcaatgctttcaggaaaatgtactccaagcattcataataacgaaatattcgggtcatttgcagtaatattgtaacttgatggaacatctgaatcaaaattgcatcggaaagatcagatttcctagagtacttgacttattatatcaagggcaaaatatcgtttagtccggtctgtctgaacaccgaccaattgaaccttaatccacatatgtagatgaagtggatcttaacgccttgtaaagaatcaatcaacactcaaagtgcatctttccgcgtataactgattgctggaccactgtcaacaataaaatctgaaatcgccccttatctcaagcaactcaagaagttttacattcttaaaacaatcagttcaaacctttgttcattttgaaccaataattttcatatgatggtgataaatatttattatcaagtatgcgcaaaaagtaacactttcgtgatttctaaaaactttttgtaatacagccattccatgtaaatccgatctagtgggtcaacgaattccgtgagaatttgctattttgttcctcatcataaataaggattcacgggtttttggattttttttattagggtgaccatttccgaaataatgtgacccaaaaaaccgcaacttcgcaatttattatttaaaaaaaaaacataacttttgaaacgcttgaccggttttcaattttctcaaacaaaatttaggctaaagatttggcttttcgaaaaaaatataaaatttcagaaaaaaataatttttttttttaatatgaaaaaaatatcaaaaatttccgtttttttcgtgttttgaaggccttgggacaaagaggggctattgctgttctcattttttcttgaaagttcagaaaattttacgattactgtcaaattttcagcgatgtatgttttttagtttttgagacatatatttttgaaaattaaaaatcagtatttttttatatgcacatactaaaggtctaagcgcattagatttttaaaataaaataaaaaaaatcataacttttgaacagctcaaccgatttccaatcttattttatacttttcagaaaaaaattaaaactctgttaaaaagaatttaaaatttctagtttttctggaaatttttatttatgctcatgtcagaaaaagtgagttttatatattaatcttaagtttttattccatgaaataaagattggtaatcgtttgagctgctcaaagctatgattttttaaattaaaatgaaatgcgcagagacctacagtgtgttccaataaaaaatgattgatttttttttttttcaaaaaaaaaaaatacagtattggacagtattgatgtgctgttgctcatatgtttgagctgaaaacttcaattcaaatgcgccagctcatagaacgaccaaatgagctgaatttttcagaaaggcttcctctaaccccaagaaataatcctggggggtgccccgtggaatcatacaactttatttttctcccatactgagctgggccagtctactgactcataggccaaccaaaccagcaagcctctctgccataaaaattatcccagcccttcacccttccctcatgaactggcgtagacgcaatggtacacggagaaatcagaatacccaaaaaaaagttctttttactcaaatttgggtaaactgcattcagtttttacccacagttgggttgttttgcctctctcgcaacagcaatgttgtcaaaaacagagttagacgcaccgacccagcgtcgaagtttaatggaataagccaaatttggcttctttcgagtttacctaacgttaagttgttttaacccatcacggagacttcgaaagctaacgctgggtagatttttttttgcactgagctgcttgttttgccgctgtcaaatggaaacaacctaatgataggtatatatcaggttatcaggttatcccacggaagagccgaattgcgtcaaaagaagtcgaatttgggttgatttgcggcttcgtgtacaaacggtctacagtgggagccagttgaatgcatcatcaactcccctttctcctcattggtctgcattccgacgtggcaggcaccgttgttgcctaaaaatataagatcactagcacttatacacttagggtgtctgtcaatccaaaacagtcatctggttggttccttgtgtaggttcagctgttctggcgatactgtagtagcaaccatgggcggccaatcaaactcaagctctccaagatagtactcatcaagctaaattgaaattggaattgaattaaaactggagtatatgactgattttttttttcaaaaaaaaaatacagtattggacaaaacatttgcaactttttcgattttccatacaaaatgaccaactttggtgagctatatctcagtgatttatggaccgatttgaacgaaattttcacagaatatcagatattacttgaattctaacatatattttgagtgatttttccaatcacgaattgaaaagcagtaacggtttgactaaagtgaattttttgacgattttttataattgacataactaaacatattgaagggatagcttcatggtatcttcagcaaagttgtagattttgacgagattaataagtttgctaaagacagtttttgtgtagggctatcagattttgagataaaaagtttcgaaattttcgtcgaaaattacactttagtcaaaccgttattacttataaactcgtgattgtaaaaaatattcaaaaatatatgttaaattaaagttacatcttatgttctgtgaaagtttcattcgaatcggtccataaataactgagatatagctcaccaaagttggtcattttgtatggaaaatcgaaaaagttgcaaatgtttcgtccaatgggcacctgccctcaattctcaaaaagtaaaaacatacatcgcaaagaatttgacagtaaacgttaagttttttttaagaataaatgagaacagcaatagccccttttgtcccgaggccttcaaaacacgaagcaaacggaagtttttcattttttcatgtaaaaaacaatttttgttaaattttatatatttcttgaaaagtcaaaatctttagctttcattttgaaaattagtcaagtgattataatttgaaaaaaaaaaaaatttggcaatgtcgcggtttttttggtcattctttttccgaaatggtcattctaataaaaaaaatccaaaaccacgtgtatccttatatcggatatggaacaaaatagcaaatattcacagaattcggtgacccactagatcggttttttatggaatggctgcaattattccctgaaacatgaagtaaatttagtagcattgcatggaggaaagatgtagcattagggcgattcaaattttaaaaatgtttgagtatccaatcttccatatgccccttaccttccttaccataaaaatagtgttctgtgaaattttcagctttctaggtggcgatttaaaggtggcccaaaggcaatataggtttatatggaaattactatggagaaattttaaggaatgttccaaacacgcttgtactgtaatgtaagtagaaacttatcatcccatataaaaactaatttttcaaactttcatgaaggatgttgctgaagaaacaaatcccttttgtgctaattttgtttaagatttttgtagatgtttgcagggctataatcccatattaagctaaatatttgcaatcatactcatgaatatctcttctgctatccatcggattgaatttctcttttcagtaaatttctttattatggtttgaagaatgagtttttaccatgggataataagtttgtacttacattacagtacttgcgtgtttgtaacatatctcaaaatttctccatagtaatttacatataaacctacattgtctttgggccacctttaaatcaccacctagaaagctgaaaatttcacagaacactatttttatggtaagggtggtgaggaacatatggaagattggatacccaaacatttttaaattttgaactgccctaatgtagcatcaattaaaataattttagaggccattttgattttggcctccattttgaattttatcaggcaacgtgttctcaccattagcgcgccgctcgttttgaattcagaagacaccataaaaaagcttatgaaagagcggagttagagcggaaactgagtattgataataaccgattgaacgaccttttaaatcaatgaaaaaatcatattttacaataatgtaacgctggttctttcttcgtgtcgactgtaaaatgggattattgtttttaagtgcaaaaaaatctggtggttatctagaattttgacgacatcttgcttctaagcgaatgaatgagcttttctaaccaagagagtactcatcatgctaaaacggggttggtggtctaatggctaccgctgctgcttcataagcagaaggcaatgggttcaatcccaagcccgtccctttcctcgtactttgtagttgtatctttcacttgcttctatctaccactcttaatatatcacagttcatagcatttgctagaacccgagacggacagaaaaaaaaaacgtttccctacgcttccattctttcattgcacgcctttccttacgcctgactcaatagactggcccttaaacaaaaaagttgtaaaactaaatggggcaccccctatatatgagccttagggtaagagaaacgctctctcaaaatttcaactcgattggttgctccaccagctggcgcattcgatttgaagtttgtatgggatattcgtctcaaatatatggaaaattgatcctatgtcactgtttcgttccgtatactaattgttcacgttcaaataaacccagaatgacaaatacactagttgataccctaataaacataattgcagaaggttgtatctggatttaatctcattttcattactctttcagttgttgaaagttaggcttagatcagcactcccgtacagtcacttatatgcatgcgacatgtgcctcagctcgcccagcgtcataggtggctatgatgcgcttagtggctacctccaagctatgttgaagaaatacaagcagtattgcattatatacttcagaaggttaaaacaccaactttattaattttgatcatggtacaatcttctacaatattcttcgctattatatcaagtagtgtttttgacattctgggtccaattgaacgcgatcatcaattttcctgaaccaaacagtagatgatgtgctgttgctcatatgtttgagctgaaaacttcaattcaaatgcgccagctcatagaacgaccaaatgagctgaatttttcagaaaggcttcctctaaccccaagaaataatcctggggggtgccccgtggaatcatacaactttatttttctcccatactgagctgggccagtctactgactcataggccaaccaaaccagcaagcctctctgccataaaaattatcccagcccttcacccttccctcatgaactggcgtagacgcaatggtacacggagaaatcagaatacccaaaacaagttctttttactcaaatttgggtaaactgcattcagtttttacccacagttgggttgttttgcctctctcgcaacagcaatgttgtcaaaaacagagttagacgcaccgacccagcgtcgaagtttaatggaataagccaaatttggcttctttcgagtttacctaacgttaagttgttttaacccatcacggagacttcgaaagctaacgctgggtagattttttttgcactgatttgtttgttttgccgctgtcaaatggatacaacctaatgataggtatatatcaggttatcaggttatcccacgaaagagctgaattgcgtcaaaagaagtcgaatttgggttgatttgcggcttcgtgtatatacggtctacagtgggagccagttgaatgcatcatcaactcctcccccttctcctcattggtctgcattccgacttggcaggcaccgttgttgcctaaaaatataagatcactagcacttatacacttagggtgtctgtcaatccaaagcagtcatctggttggttccttgtgtaggttcagctgttctggcgatactgtagtagcaaccatgggcggccaatcaaactcaagctctcgaagatagtactcatcaagctaaattgaaattggaattaaattaaaacaagtactcttttattctgataatcttcattaaaatattggtgatatttcttatgagacgacatcattgacgcctgggagtagaaacgctctctgggctatagaaacgcctctctcaaaaaagggacgactaagaagctcaaattttacgacgacagggctgttgataagagttatcaacaaaaagcgaaacttctacatggcatttatctgaagaaacacgtccctttcttggctgccggtcgatttccgaccaaccaccatttggtcaaacaataaggggttaaacaagccatttcccgaatcgcatattcatgttccgaccgaaacagactggtcctagtggccgccaccaccatcaacaactacgcccagcgagcttgagagcaggccgaagattagcatacacattaattctaaataattagccagcatcgcgagtcggggtctggcttccagagccgccccagcgagaacacaagttcggtagggatttgcgtcgctaatcccgttgtttaatgggagtgatccttgcctcttgcgcacgccgggatgaaaaagtgaagtgcgggctaccgttgcttctgacggctggttcggacgaccgcgctatccgatgcactgcgaacaggaaaccgcaaatattttgaataatacccgaaccccgtcacaaatggaggacttccggttcggttcggttcggcctcaatgagttgcacgcgctgctgcaggaacaaaaggccttcaaagtccattcatcgggacgcaggctcggttctgactgccactcggtccggttgttgtgtttgtcgtcctcggatgaaaaacgaacgacataatgagatttattttgttctgtgatattaattgtggaacgtaaatgcagattgcgattgtggctggcagccaagcagcagcagtagcgatatgagggtgaaattcggatcggtatatcgccaacctgatgcggttccgatgcggttggacttcataaaaataatcctccccggctgccaagtgaatgtgggggaccgcattgggaaacgatttcagctcgccgttgcagttatcgaccgtgcgtctccactgggagtagtgccttacgtagggaatcgatggcagccgcttgcgttgttccggtgcggagctaaaactaccccaacattatgaactgtttcccacctaagcccaacaataaatcactttaattagggagacgaaatttgcatattcaaatgatatttatggtcgaactgttggccgttttgcgcgcttcgatgcggaatccgattagcacagcacatgggtcgaaggtgccttatgggtacctgccctgctatacgagtgggctgttctctgcacagagtgcttcccttcttcacacccacaacagtcggtgacaacaacgaacgacacccaggcgattccgattttgctgtccgattgttggcagccatttgtttgctttacagtccatccattatgttagttagttctgtacttcctgctccttctcccacttctcttgcagagggataacaggtcgcggtcgggacaacaatatttaggtcatcgtgattcgcgaaccaatcgtcagaaatcagcttattataatgctactccgcgtgtgcttttcctgagcctgtgaacggtatccatcgggaaaactattcgcctgtcacacagtgctgcgttctttggacaaaagtgaaaaaagaaaataaattagggtccattattgagttgtatactcaaattatgacatttcgattttcaatacatattccgcatatttggcaacactgtaacttaatacttgatgcactcaaaaatgtttaaaaattacaaacacaattttaaatgatgtaaaatttcaacaatttattccttgttttcttctttcgatattattttaccatattaaccaaaataggaaaattgacaaaactgttacgacttttttgttgtctattacttgttccaagctcaaacaacctagtatacgttaatttcgcatatttttcgtcgaaatccaaaattgttcggaaaattaggagcctaaaactaaattttctaaagattggcacaaagtacctaggaggcttaaatgttttcggctgtaaaatgtctgataaacacgatgaaatcatttttttaaatccactcatcgaaaaatctgtgtcaactttttatattgaaaatatatgccatatatactggcaatactgtatccaagaaaaatattgcttctaattaaaaagtccgaagatatttttttttatttgttcctatctataatacttacgaagacaaaaaaatgtatgtaaaatcatgggttttcgtttaattttctatcacggtgttggtcctatgggccgaagagtggtccgattgacatacaaactcgctagtatcctttgatagatacgcgtatttcgacctcatttgtgaggccgtgacgtgtactagactcgacttccttctccacgatactgaagacggcctaacagttgagatcgaaatacgcgtatctgtcaaaggatgcaaactctagtggaattaaatggtaaagtactaaaatcggtttttcgtttatttatagctaatccaccaaacagctcacagattctcacaatttccgcagtatttctgcacaattcccagagaattcttaattctcacatgactctactgggatttttaagtattaactactttttaagcattaagttttttgttaagattctcaaagtatttccacgtcatactcgcacgaatactaattgtttgccacattgctccacaggattttcgttctatcagaaatttccgcagtatttctgcaacatttgcatagtatttccacataagtcttacatgattccaacagttttgccactgaaagccccggattcttacaagaatcctaggattcttatctagccattcccatttcaatgcccgcataccaatatccacaccggaataccagaaaccttactggaattacgtgatccacactagaattccttatttgttatcttgggatccacactaaaatccaagaatccacactggaaaatcaaaatccacagtggaatcccggaatccactctgaaatactagaatccactgtggaaatccaggacccatactgaaatcccaggatccgcactgaaatccaaggattcatactgaaaactcaaaacccttactggtatccaaatatctcttctgaaattctaggatccacaccggaaatcccggaatccacactagaatcccagaagtcacttttggaaccaagagctcatgtttcaatcccaacatacacactggaatttcaagatcctcattgaaatctcaggttccatgctgggattccaggacccacgttacaatctcaggatccaaacgggaatactaggattcacactggatcctaataaatcacacaacctcactacgatccgaacaagtgctggaatactacaaactatactgcaattccattatagacattccagcttaaaatccaagaatccatactaaagttctactatctacatacaatctcaacatccacacgggaatcagaggatccacattgaaatactgattttgctaagttggtaagataacgtattctattgaataattagaatcattaaggtgaaacattttggaatcaaatataatatttaaaaggcacaaatctcgcgaaaaaagcatccagcaacagtgatttttttattttggcttcgtgcactaacagaaagcttaaaataagaaaattaaaaaaatttgccaactatttcttcagttttgtgcttttgaaaacatgaatagggacacaagttggccattgtagcgaccatctttgaattccttgatgttccatctttacttttgctcgataaaaaaatggtatatttactgtagggaatgtgtaccagttatggccaaagtggctccctatttgaacatatgtaaaattttgataactttcacatttttaatctttttgaatgttttgacatcaagatatacctactacaacacacaaaaccattcaaaatgtgtagacaatcaagtaatcacgtatggcgaaattgggaacctctatatccataactggtgcacatagcctagtcttattttaagatttcacacatctttttatttgtaatttgaagttctgccaaaatcaaggattgcgatgattattgaatgaactttttagaagtttttttgtgcattgactgaaatatttagctctagtgaaattattattcttcgaaaaaatcatcattcttaaaaaaaactgttcaacaagttatttcattactcaactatgtgtttgaaatatcatcgttcttcgtaatggactgctaatctttatctgatggaagcattcggagagagtcctcgggttctttctttgaattccgggtcttgcagcttatggacgtgagaaacattttcagttttagatacatggtgtcttcgggaaagtttctccacatttcttagaaacgtttttcagtgatgtgcaattagagtggcctacatggtttacgtaatccgaatacaaacttttttgctgacgcattaagacctttataatgtgctacaatgttttagaacaaacgatttggagcaactttgccggagaatccaattttatatttataagggaagtcctgaaaaatcattttttttctcaatttttattcgacattttcttgcaaaaacttagttccgagcacttttagaacttttgattgagcaccttttggccggagaaactactgttctatctctataattatacagagttatcagagaaattcttcgaaaaaaaaattataaaactgctttagggacccagatagccgtagcggtaaacgcgcagctattcagcaagaccaagctgagggtcgtgggttcgaatcccaccggtcgaggatcttttcgggttggaaattttctcgacttcccagggcatagagtatcttcgtacctgccacacgatatacgcatgcaaaaatggtcatggcatagtaagctctcagttaataactgtggaagtgctcataagaacactaagctgagaagcaggctctgtcccagtgggggcgtaacgccagaaaagacgaagaagaaaactgcttcatcaaataatttaactactcccaactccttagacttagattttgaattgcaatatacactttaaatggttttgcagtttagaacgtatttgagaaaagtagggacttgaaaaagtgttttttgtgtatgctggtcaaattttttttcttgtaaagactgttcctagaaaaaattctggctatgccaccgcatcatataaataggatagcgaaaaaagataatatttaagttcttttgtcaaagatttcaaattttttgttagtgattcgcttatccagaggactcgattatccggagtgaaaaaaaaaatcgatactccggataatcgagtccgacctgtacagccattccatgaaaaaccgatctagtgggtcaccgaattccgtgaaaatttactattttgtcccttatccgaaatatggatacacatatttttggattttttgattagggagaccatttcccaaatagggtgaccaaaaaatcacgattttgcaatttttttttatattataacttttgaaccgcttgaccgattgtcaattttattggacgagatgaaagctaaagattttgaattttcaagaaacataaaatttcacagaaattgttttttgttttatcatggaatatatcaaaaatttccgtttattcgtgttttgaaggcctcgggaccaaaggggctattgctattctcattttttcttgaaagttcagaaaattttacatttactgtaaaattttcagcgatgtatgttaattaatttttgagatatatttaaaaaaacagtcatttttcatagataatatagaaaatttctagttctttaggaaattttaatattttgcatgtaattttttttttcattccataataaaagattgggaatcggttgagctgtttatattgtatgattttgtattttaaataaaaaatttaatgcgctgtatgtatgccgatggaaaatgactgattttttatttaaaaaaatatatctcaaaaacatacatcgctgaaaatttaacagtaaaagaaaaattttctgaaccttggaggaaaaatgagaatagcaatagccgcttttgttccgaggccttcaaaccgcggaaaacggattttttaaattttttttttcatgtgaaacaacaatttttgtgaaattctatatatgttttgaaaagtcaaaatctttagccatcatttcgtcgaagaaaattgagaatcgatcaaacggttcaaaagttataaatttttgaaaaaaaaaatgcagaatcgcgatttttcttgtcaccctatttgggaaatggtcaccctaataaaaaagtccaaaaacacgtgtcaatcaaattttcacggaattcgatgacgcactagattggtttttcatggagcaaatatcttttatttttcgatttctttcgatatacattttgatttatgacgaataaatactgcagcgcaattgattttatgggtactttgtatcaaacactttcagaactttcaattttgcacttttttgctgaaaccactaataagctgtgtcgattgttattcaagttatttcgtttttcgtttaaaacatattatttccaatattttgttaatctcatatcacagttttcgcatctcatcttcaaagttttcgcataattattagagaaaaagataaagttcctaatggcgaaattgagtattcgtttgcgccttccaaagatattacatttgcaaattgattactctgataactctgataattgataactctgcaaccagaaaagatagaataccgtaaggcgtggtgacattggtccataagggtgactttgggctaatatttttacagcaagctaatgccagaacaatgaaaacaacatgtcaagcttaaagaatacgtgataaatagccaatagatggtcatacattagttttttgacgtttctgctagccataaaatgcatcgaaagaggcggtcaatgtcacccccgaggcccaatgtcaccccgcacggcggtagtagttttctcggaaaaagttgtgcaattaagagttccaaaagtgctcggaacaaagtttttgtgagaatttatcgtataaaaagttatcaaggaaaaaagaaaaaaatcagatctaacctaacttatttgttaaaaaaaataactcgcgaaccataagtgatagtaatttgggttcttaggcgaagttgttctaaattagttgttctaaaacattaaagaacattgtatagacctaaatgcgtcagcaaaattattattggcgttgcagcatctccagtgcatggagagtttcttcgttagatcaatttttgtttttttagatgatggtcttttgatagataacaagagttgttgaacaatggttctacgttgttctactgaaacaaaatgatctcatcagtttgtgcagcagaaacgctttttctgacgtatacaataatctttgtctttccttcttcttttcggcgttttacgtcctggctgtaacagagcatgcttctcagcttagtgttctaataagcatttccacagtatattatcatgagctttctttgatcattgactatttttgctttattatatggtcggcgttaagtcagagtggaccaagtcacatttttcatattttgagaaaaatgggtttaaagtttaacgctttgtaatttttgaactcgtttgaagttaggttcaatatttctacacctctttgtattactttcaaacaatataatgtgaagtgataatcatgaaaaatcgtaattcaaacctctgatagaacgattttttgatggaatatgtatacttggtccactctgactgaactaaagaccaccgttcggtgagttggttcactctgactgaacaatttctaggaaaataacaatcattcaatgcttgcatggtcagactgggtacatatctctaagaaaagcagattatcaagacccttcgacaccagtattgtaaattcttctatattccattggtcaataccatgatcagtggcattacgatagcttgaaaattaaggttttgcagggtcagggcattgaagaccagaaatattcaaatatgtgttcagtcagagtggaccaagtgaaaatcttgagtaccgaccaaaatatactggtccaataagcgtgttctagcacactccatacatacaccacagcttctatcggactctggaattgactcaaaaaaatgcaataatcaattagtttattgcttttcaacacttggtccgctctgtctgcacagaaattgttgcaatttctgaccacccatccaaatatggtaaaaagtcaaaaatcaaaatcaaatgcatcgaattaagtaatattaataaatttctattgatggataagtaaaagaatcattcgatgtcgaaaaatcttacaaatctcttgaaatgtttttcatttcctagcattcctcagcgcgttgatcattttagctgttatggtaataagcacttggtccactctgactgcacactttatcgatttttattgatcatccaaagtaaatttgccacatatctctcgcagtttacagcattcatcaaatctggtcaaagtgaaacggaggtaaggtaatttcgcatctaatgagagaataatccaattttcccaaattttgtacttggtcccctctgacttaacgccgaccatatggaccatatgaccatttcaagagatttgtaagatttttcgacatcgaatgattcttttacttatccatcaatagaaatttattaatattacttaattcgatgcatttgattttgatttttgactttttaccatatttggatgggtggtcagaaattgcaacaatttctgtgcagacagagcggaccaagtgttgaaaagcaataaactaattgattattgcatttttttgagtcaattccagagtccgatagaagctgtggtgtatgtatggagtgtgctagaacacgcttattggaccagtatattttggtcggtactcaagattttcacttggtccactctgactgaacacatatttgaatatttctggtcttcaatgccctgaccctgcaaaaccttaattttcaagctatcgtaatgccactgatcatggtattgaccaatggaatatagaagaatttacaatactggtgtcgaagggtcttgataatctgcttttcttagagatatgtacccagtctgaacatgcaagcattgaatgattgttattttcctagaaattgttcagtcagagtgaaccaactcaccgaacggtggtctttagttcagtcagagtggaccaagtatacatattccatcaaaaaatcgttctatcagaggtttgaattacgatttttcatgattatcacttcacattatattgtttgaaagtaatacaaagaggtgtagaaatattgaacctaacttcaaacgagttcaaaaattacaaagcgctaaattttaaacccatttttctcaaaatatgaaaaatgtgacttggtccactctgacttaacgccgaccatatcgtgtttcaaatttatcccattagtgggactgcattcacacaacacgcatgacatatatcgttcgtggaagagccacaaaaggaaaagacacaccaccaactttttggcgccgatgtgtcaccacgtgttacattcgttgacactctcattctgatcaagaaacagaggcgaatattttccattttctgtgctatgtttgcaatcaaaggggtgttcgattatccaatagcttttaattgagttgtttaaagatgcatttccagaaaatatggacattattgacaattgtttgcaaaacataaatcacccgtatggctcgatattgttgtagtctgtgagagttgctgctctggaaaactctctcgcaaaacgagagagtgaatatcaacattcatagggctgtccgatagaggtgtgccacgaactgttatggttcacgaactgttacactctctgaatatggttcgatcggctaattcggtttaaagtccaaacactgaccctaggcatggtttgttgaatagcatcacttaatgggtgtagatattgaattatatgacatatataaaattgtaatctacctcagtgaacatggcaccgctcaaacgtcaaattagtgaactcgtacaaacgtccatgagccgatgcacgagttcacgaatttgacgtttgagcggtgccatgttcactgaggtagattacaattttatatatgtcatataattcaatatctacacccattaagtgatgctattcaacaaaccatgcctagggtcagtgtttggactttaaaccgaattagccgatcgaaccatattcagagagtgtaacagttcgtgaaccataacagttcgtggcacacctctatcggacagccctatgaatgttgatattcactctctcgttttgcgagagagttttccagagcagcaactctcacagactacaacaatatcgagccatacgggtgatttatgttttgcaaacaattgtcaataatgtccatattttctggaaatgcatctttaaacaactcaattaaaagctattggataatcgaacacccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcgattattattattattattatctttatcaacaagatttgcagcccgctctaaatcgatattgagatacgaaatatcgagtaagggagagttgactgtattctcttcagttacatttctctatggatgtttgtatgagttcactaatttgacgtttgagcggtgccgaattcactcgttgccatggtcacctagataacacggcaccgctcaaacgtcaaattagtgaactcatacaaacatccatagagaaatgtaactgaagagaatacagtcaactctcccttactcgatatttcgtatctcaatatcgatttagagcgggctgcaaatcttgttgataaagataataataataataataatcgatttagagaatctagtgaaagttggttttcatggctacctcgatggttccttggatcactgttgcactgtgttctgtaactcgatacctccctaactcgatggtccttgtaatatcgaattgtggaaagttaactgtagttatttcatcggaatattttttaagggacagaaaaatgtcattatagaagttgtcgttataatgagcttcgatataggttgtacattttaacgccaaaaggtatgctagttttaactctactgaaaattgtttcctatagacattatagagttgtaacgtttgtaacgtaagtcatgatttatgtccctcgatcccataccttcgaagcactgtgcgtcatcgatagcatcaggtggagtgggtgggtggaccaaaccaggattgacacaaaatacacgcgcatctgggaaaacaatggtcaattgattttccctctccgtgatccggatcacagctacctagattgtgttactaaacggctaatactgctgcttttaccatgctttggagataaatagcgagcagatcccgcaccacgcgtcaaagccaacaaagcgggccggaaagtcaagccgattttcgtgatcaaaattgataaggttgatgctattatcagcattagtagttgtagcggcttttgcggagttatatcgcattacgttgcatcatgtacggatattgagagttgcgtgagtattctgggaaagtgttttattatatgcatactgattgtttatcaatcacgtttaatacgcttgcaataatgaaaactgttgaagtatgtaactgaatacatattactgaaactctggcagaatctttctctgcccctgttgcgaaacgaaaaacgaaatgccagaggaaagatgaagacataaagttcgaattccgttatcgtagtaggttattgactatacaggactctactgtgaaacattcaagacaaggttttaggagaaccatgtcaagtcaaggcaatattcattacaaaaataccgggaatcgaactcagacaccttcaggagagcgttgctttgtagccgctaacgttaccactaggctaaggaaggcctccctccatagatgaaccctttttaaaataatttacatttaaaatgggatagctcgctaattggaattcgtcccatgtacaatgatcaagaaaactatcttgaaggaaaattcgtagtatttttttacgaaattccctaacaacggtagtgcatttcacgcaacaaatagggggactgggggtaatatgcccatgttaagggaagcagtgattttagatgtgaaaaacattattttatgctcatttttaattatggtcggataaaccaacatatttactatcaaatagtagaaacagctatcaatagaatttggggtttataaatcaattttcaaaaaatgcttgcttaactgcattatgtattgttttgcgggataaaacgccccgcttgagttcggtgttactcgcgctgaaaacgtacgcacacaatcatgcttgcttatatgctgcatacatccgggcgtttgttcagatgttattgttcaataatagcatacatgctgatgcgaaagatgtgcttttgtaaggttccaatttgcgcgtgactaacgtagcattacgttaggtagaatttgaattcaaacggctgttttggtgttatgaaataggggagggcgttttaccacacgagttgataaaagcttaggtccttcaataagcttttaaagaacaaatttaacatattttttgcatgtaatacaaactatgaaagtgcacaggtttgctctcgtcgttagtttcagaactttggttatttttcgacctaaaaaatggtcttgaaaatcgcacaaaattgcaacgaaaatagcgaaaaacgttgtatccgttttttttacaatttttttgagtgaaacacataaaaacatattaagagatgcattttgtccattaactacaatcttgggtgaaaagaagctttctaaaacacatcgtttgtctaaatcaaggatgacacgttttgcctcctatgggcaaatttaccccaattcccctacatactgagtaatttcaagagatctctgtggagacagctgtaaagtatcctgtgaagaattctgtggagaacttagagacaatttctgtgaatacttacgtacacattattatacctgcgcagcaatcatattggaggcttgcctaaagatttcttttgggttcctgagaagacttctgtaagaatatctgtaagcttccgtggagacttcagtagaaatctctttggagatcgccgtgaagattgctatatagggctctaacaagacttctcgtcgcaaacccggttcagatgttaatgtgtcgtgaatcatactaccaaccatacgtgacccccagtttctaccttatcccacttatccaatattatttccattacagcagttgagatgcaacgatttactctttagtccttattagaaagaaacaatgattgcctaactaacattcctccccttctcagttggctgaaaggacgtggccggcgctgttattgacattgaactctcaattggtcggtgttcagacggactgaaccaagtgtttttcaatgatgtctggaaaacgtacccaagcgtccagaataaaaaaaatatttgcattttttgctatgatagtggaacttatctgtttgatgaaacatctgtatcaaaatagcatcagaaaaatcagaattaacggagttcttggcttatcttaacaaggccaaaataccatctcgtccggtttgtctgaacaccgaccaattggtgcacattgaatacagtatgctaatcccaatcaccattagttgaatgtctgtgtacttcgattgttctggtcattcacgaaacgttttttcatctatgctcatgctctcaagattctacctattactatgaatgacataaatccaaatgccataagcacagataccatttccccgaatcctataaccccgaatttcgtactaaatagggaagtgctatgcagattcataaaccctcaagcttcaaagaaaatgattaaagatatacatttaactcaatccattcccgaagaaacaactttctccacccaatcatctagcattcatcgtattcaataaccgtttccgctattggccccaatcgaccgtaaaacaattcactattgccccggctgtcattccgtaaccctttctcgacttcactcggttctaccttttctggcacagattcaggggatggaagaaccgtgttctgagagggcaggaaaggtgatcccggtttgcaacaaggcattaaattgattgatttattatgatgtaaaactgttttatcgttttccgggaaccgcccatcttcctccttcggcacgtagtcgtcgtcgtcgtcggcaacaaaggatagttttgctccacgcttctataagaaaccctatcatgatgctgattcgaaatcatcgccagtagggtggaccataatgatcaaactacaacaattttaacaactatttttgctcctgaattcgctcatttggacgcacaaaaataaaaattactgttaaaatttgagcagaacccatcaactctaaaagggagctaaacgaacttgtagtttttaggaagtaaatcgaagaaaaaatacatgggaaaaacggatatatttacattttcaaccatagatagcgctgtggtcatcgaattttgtaatttattgatttgaagagagagtagagtgagcaataaaaaaaactacagcaaaccggaagtcttttcgttaataaacaaaaaaaattatgccaagagaaaaaaaaaactagttttcttccttattggaaagggcagctaagcttgtctcaaaaaacctccgattcggtttaaattttgtaagtcgaatcattattcaaaatttttagacccgtattaagtataacttttaagtttcttgaagacataatctccgatttgttgcagtcttttctctattgattgaaaaatcttcaaatcaataatgaagaaaattcatcgactacagcaacatcttgagtctaaaatgttattagatccgattttcctacacaattgagtcgattttctgcatacaaacttcttagttatctcccctaagagtttaaggatttcacccaaatttttacagtagcttctggggttccacattagtttactgaaagtgttactcaaatgtttacaaattgattttttccttacaaaaatggaccaccctaatcaccagtcagcgtcagagtaggagagagcacataccacccttgggtgctattcaatatgtctcaattttcgaattcttcagtttcgccccccatatctcgtcttgctggagaactgcagcattcccaatttccgtttgctgctgctggatcttctcaggaccaagacggtcttcggtcatctggctcggttctcgcttcttcagctcttggatcggccagcagatcggatctcgttttatcgtttcgcagtctaaaggaacgagcgctggttggtgtgagtaataatgtagctagattttattctagggggggattagtgggagttagcattttctgatgtgcaaaaccataaaacctgtaactccggataagctatcattcatcattttagcaggaattcatcccgagaaactgcaacagactcttcaaaccatttcttcaatgttttttgcggactttttccaaaagtttgctctaagtttttttcgggattttcatgactttttccaacaaatcattctaaaccatggataaaccaaaaatctggccagggatttctataaaccagattttgtttagaaaatttcccctgatgtcttttaagtttttttcttgattatcttgtgtaatatatcatattatatcataatggtacataaataaacttcttacggaattccaagaagaagattttcagaagaagctgaagttttaggaaaatagatcagaaaacgaatttaattattatttctgaaatacctgtgacctgatgaaaattgttggtggaattatgcaacagttttgaaaaaaaaaaatgtcaatcataattatataaaataaactaggattgcccccaccccctgttcctacgccattggcactgagatggaaaggacaccaccgggaaagacaatcctttttctgggtttgctgcttgctgggaaggtgccaaccatgtggggaaggcagctgggaggatcgacacgggataacgcagaagcaaagtggagtattgaaataaatgatgttgtttcagctatctctggcctgcgtctgtctcccaagtaagggggattttctgctcgaaaacgctttgattcaacattgttaagataagagaaaagggatgaaacaccagacgcttgaatgggtttgcttttgcgtttcatcaaatgaaaatttgggaacggtcctggagaaaaaaaaaaacactgagcttgaacgaagcggacgtttctgggacttttgtgctgcaatttaaagtttcatcttccgacagatggagcaaactgcaatatcaccttttcaacggtttttccaggaaagggagtccctttttcaatagacaaacggttacttgttgaaatgtttgtgctccctaccgacgatagctcccaggcaatatcgaaccacagtctggcgcattcatgggcaagtaaaccaaaacaacttgagattctttattgggaaaacattttctgctttgatgacaccagtcagtcaatcgtgatgttggtcccttgcagttagcagaaggaaagtgtgcatatttgttatattgccaggttacattgtagggaatgccgttttttcctacccggggttccaactttgttgactctgctttttgcaagttgaaaatgatgaaacttagtttccaaaataacaatttatcactaacgagactgcagcatctttttatatccggtgattgccgagtatattttaacagtcgcaaagttacccacttttcttttacctttgatggcgctacgtcctttaggacatgacctgcgccacaatgtaacgccaacaaactcggtccctggctgctagcctccagtttttgatcgccatacacttccaagcgcctgctccacttagtcaaaccacctagcctgtttcgccatcttcgtcttgtaccggtcggacttgagttgaacacaatttttacaacgtgccccgcccatcgtacccttccagttttgacgactttttgaatactgggttcaccgtagaatagttcaagctcgttttgattcttctcctccatatgccattctcacatactctgcaaaatatcgttctaagcacacgacgttcaaaaactcccagctcttgcaggtcctcttcgagcattgtccacgtttaatgcccgtagaggactaccagttatcaacttcttgtacatggtacacttagcaccgccttgaactcatccccgtcgctcatcacgcgtctgccaaagcgagctctatcgcgctcggttcctccagctagcagatatttcgtcttcgacgtatttaccttcaatccaagttgttttgcttcacgtttcagactggtatactgttaagaaaccacttgtaacgttcttccgacaatgtccacgtcgtcagcaaagcagatgaactggctggatttattgaagatcgtgccccgcatgttaaagcccgcctgtttcataacatcttctagcgcaatattgaataggaagcagaaaagaccatcgccttgttgaaattctttgcatgtttcaaatgggtctgataacgcacccgatatcttcacacagcactgtacacaatccatcgttgctttgatcagtctagtcagtttcctgggaaaaccattctcgtccataatcttccatagctcttcgcgatcgatggtatcataggtcgcttcgaaatcgatgacaaggcgtaggaacttgattttcacgacacttttggaggatttgccgcatcttaatttgatccgttgttgatcgcccgttcacgaaactggatttataactcctcacaaatgtgcttgctagcagcgatagagagctaaagatgatctgggaaagcactttaacgttaagaatgatgatagcacgacagctctcacattgtaacttgtcccctcattgtatattgggtatattactccctctttccaatcctccggaagttgttctgtatcccagatgctgactccaataccatctttcccttctgatttgttgttcttgaactgtttgaaagcatccttaataactccacctattgcgagaattagcacgtctccctcaaccaccgcaccgatgaatccattgcctatactgtctacattagactggcccagctcagtatgggagaaaaataaagtcgtatgattccacggggcaccccccaggattatttcttggggttagaggaagcctttctgaaaaattcagctcatttggtcattccatgagctggcgcatttgaattgaagttaatatgggattttcagctcaaacatatgagcaacagcacatcatctactgtttggttcaggaaaattgatgatcgcgttcaattggacccagaatgtcaaaaacactacttgatataatagcgaagaatattgtagaagattgtaccacgatcaaaattaataaagttggtgttttaaccatctgaagtatatcatgcaatactgcttgtatttcttcaacatagcttggaggtaaccactaagcgtatcatagccacctatgacgctgggcgagctgaggcacatgtcgcatgcatataagtgactgtacgggagtgctaatctaagcctaactttcaacaactgaaaatgtaatgtaaattagattaaatccagatacaaccttctgcaattatgttcattagggtatcaactagtgtatttgtcattctgggcttatttgaacgcgaacaattagtatacggaacgaaacagtgacacagggtcaattttcaatatatttgagacgaatatcccatacaaacttcataacgattgcgccagctggtggagcaactaattgagttgaaaatttgagagagcgtttttcttaccctaaggctcatatctagggggtgccccgttaagttttacaacttttttgtttaagggccagtctagtctacatatttctcctctgcgtcattcaggtgttcatcgttgtgctgattccacctctcaatcgcctcaagttcgtctgtcaagatacttccagcgtattccggcacatttcggcacgtggaacaataccatcagggtagacaatcgtcaccgtcaaatggaaaaagtcggcgacgaaactaaaagaagcatcgtcatcgtcactcaaccatttgccgcagagatcggatcacataggctgagcgtcatgacgaacaaatacgattccttagttacgggagaatcttcgttcgggagcactgagccgacttaaaatatgaatcatgtcttggacagattgagagcatttttttgaagaaataaaacaacaacaaaaccacaaaacttgtctggcatcgaagaaacgatctctgaatcgtcaactccacgcgcttaccaacagagctatattagaatcatgcagccatttcatgaaaaaccgatctagtgagtctccgaattccgttaaaatttgctattttgttccttatccgaaataaggatacacgtgtctttggattttttaattagggtgaccatttccgaaatagagtgaccagaaaaatcgcgattttgttaaatttttctttctaaaaaaattataacttttgaaccgttcgacagattttcaatctttttggacgaaatgaaagctaaggattttgactttccaggaaaaatataaaattccacaataattgttttttaatatgaaaaaatcaataattttcgtttttttttgggttttgaaggcctcgggactaaaggggctattgctgttctatttttttttcttgaaagttcaaaaaaatttacgtttactgtcaaattttcagcgatgtatgtttttaagttttttagacatatatttttgaaaataaaaaatcagtcatttttcatcggcacacactgtaggtctcagcgctttagaatttttttttttttaatcataacttttgaacagctcaaccgatttccaatctttttctatggaatgaaagcttaagatttcaacttttcagaaaaaaatatgaaaccttgacaaaaatattttttttacattaaaataaatgaaaatttataaaaaaaaactagaaatttgttaaatttttcatgtaatttttttttcaggttttttaattttgtttgggaagatgaaatcttaagctttcattccataaaaaaagattggaaatcggttgagctgttcaaaagttatgatttttttcaaataacaaaattaatacgttgagacctacaggggataggcaaaatgattgagataggcaaaattttgcccaaattcaaatgcttataaccttatgaaaaatggatgaaattggatgcatcaggaagcagtcgacggcaaatttggtccagttgtaggaccttccttggccatgcattttgtccattgattttctgaggtcatgtccaaatgtcattttttcagtcgcttgtatttttgtgcggtgtaaagttagatagatgtttgcaattttcttagaaactagaactaataggaagttgaatgccaccggacgcattaagattggttggaaatcttcagaaatatgaccatttccgtaaaactggttctggaaagcaaacatgactggtatttccaatcatgtaaatattatccggagctatatccaagcggacaccaagcttacaaatgatgtttcctgcagcgtatttagagccattaggtgcacagaccactctatagaaggttccaggtgccctggggaagtggtcaattaggaacatatctggaaccatatcaatatgggcttcatacttcatgattttcaaaggttatgctttccgaagcatttccagcatcaccggctgccatgaccacatttttgacaaattggagttaataccatggcgagtcatcaaattacaaatactttcgatcaacttaatcatcaatcaatcagtcaatcaattaatcaatcagtaagttgatcgaaagtatttgtcatttgatgactctccatggtataaactccaatttgtaaaaaatgtcgaatgtgactgttttgcagttatggcagtacttcgtcttaacaatatgaatcctcaaacgattggaatgagagtgcaatggaatgagaggatgttttgcttgtactctttttctcttgcttctgcgctcatccttactcacactttagaagaactcttgagagacttgtttgaacaatctggtctcacggagttgtgatggcactcttttttttttaagaaattttcctccattctgtcgctcattttttgttgcctctctgcttagtatttttgcgctacatcacaaaaagtcaaagacatcgcgctactttgaagcatgctatcgaactttggtgatgttcaggattattatcgagcttattaaaattcaagccatgttcaaaaaatggatcaaaaaattggattctcaatttaagatagcattctttactcgacttactttcaaattactctcaattcactctcgaattactctcgattaactttcaatctcagtatcttattacacgtagcttataactcagtatcagtagtattcattaccctcccgccaaaaacagagtattccaaaattacattttacgccttccaaacccacactggattccttctctaaaaagtttataatttacttgaggtttactcgtattcaacctagtctcgatgtaccttagacttagacagagattagttcagagtaggcacatcaagagcatatgtgcctactctgaactaatttttcaataattttgtgctgttaatgtggcacactctttaatgtacatatttttacggcctcataattcactttcctctcaatcgcatagtaaaattcagtgattggaaagtggtgaacatgtctactaaaccagaacaaaatcaaaacaaaatgctcgtaagcataacagtgctgatttactggcatctgtgctgatttactggcatctgtcgttgctcgcgcccgaatcaaccgcttcggaagattttaaactaaccagatagcagatacacctggtttctcttaaagcacgattaaccacccatttaccacccatcaatgaaggtaaacaacatccagcagcgctgatgtcgactgcaacccgaaccagctgataatgacagttgtcgttcgctcacgtcaactagacggcactcagcaggggtgttcaccgaatgacagagtgagtcgctcacaagtgacggatggaaatcaaacggacttcaagcactctcatcaaatgttgaggcgccgcagtgcctcaagcgggaatttctttcttcgcaaaaaataacactttattttacttcacttatacagcacacttcacttgagctttacccagctctattctatttctctactcactacttgaccgttcgccgggtcaaattatactgttcccttaaacgacgtttccactcgctttacagacccttcccaaagtatcgagaacatttcattcttctccagattggaacattctagataattcgggaatctgggtgcactgccgcttacgctgtcacaatccattgtgcgcgatgacggttgtgatgtcgacgttgagctccatttgacggcggttacgtgcgcgcacgtcactcatgagtaattgttgacatcagtcagtgaccgcgcactgctgctggcttcgggtgggttggatgctggtagtgatgatgttgctttcgcatttgacgtttcttctcacgctgttttctgttggggacacaactggtagtttactgtcgatttgaagagtatacaattgatttgtctgtctaaaccataataaatcacatcttgtgctggtcactaacgcttaaatgtttgagaacttcttccgatttcttttggtacgttcttccgaacaggcgggtgcgaacttactcacaccaagcctgttcccgagtctaccatgtttgttttgcgttgctttacacacgtgaggtgcttcgtgatgctgtggtcaattgcatgccactcttcattcactttcaattcactacaaatgcattctcgattggttgtgacacgctcattgcagactctcactctacttatatttcatttacacctccaacgctttaagacaggtagttaagtttgtatttccgagatggtgaatgatatttaaataaatttaaaattattgaaagcatactgaagggcttttcaaaacatactctccaatgttatatacatattgccttattttttttttttcaactcactaacgaatcacaccttatttaatcagagccatattcttcatatccatgactcacctttcagagacaataaatttcagctaactttcctgtctctctaacaaccttttcgactaactttttcatcttcttcttttctggcgttacgtccccactgggacagagcctgcttctcagcttagtgttcttatgagcacttccacagttattaactgagagcttactatgccaatgaccatttttgcatgcgtatatcgtgtggcaggtacgaagatactctatgtcctgggaagtcgagaaaatttccaacccgaaaagatcctcgaccggtgggattcgaacccacgcccctcagcttggtcttgctgaatagctgcgcgtttaccgctactgctatttgggcccctaactttttattttcctctaattaactttcgactcattctctactctacttccttttcaattactctttagctcaattcactcctgcatcagttttcactcaccaaaacggctcattaagtgttccaatccaaatcactcactttagtgattcggatctttgaacgattcagtggctcctgcggcttgcaaagaaagagcaaactaaactaaacgagcgtaaaaaaaatcgcttcattccccttttcattccccactctcgccaaaagggagccacagattactcgttcttttgagtgatccggatcttttgaacggcttcgattctttttgctcatctctactcaattagggcgtatgtgaagtgattgtatctctgcgtcgattttcttttctgcaaattacacggccttggtgactgttttcaactgctttttatgtttaagtagaaaattataatcgtccttcgttatgcagcatcgtaaaatgtttctaaaatcgattaagtttcgtgtactaagccaaagagaaaatcgacgatgagaaatcgatcactgcagatacgccttgtctgatactcaatgcgcgaatttattctcaccattgatttatttttcaataatctgcgtgtggttgataacgcaaagctaaaatgcgtaaatggcgcttttctagaacagggattagtgcatcttaatcaacatttttattgataactttggaagaaaaatcaccacaattaataaaataacaagatttttgcaatttaaggcacatacctaatctcattttgatcgccaattgaaaattggaactaattcgaaagtatgctaagaatgaatggatcattaaaggtagtttttgtcagtgctcagctgatcaaaacatagacgccactgtatatgggatttaacattgtgacagcattgctgttctgtcaaacacacaaggctactgtgacgctatctatgcttttgatagcggccgttttggttattttaatgatccattgagagtaagtcaaaaataagtcgagatgaagtgaaccacgagtgagtccttaaaaaatctagaataagtaagataaatcgtccgtaattttgaaaacaaattaaatccatagtggtttgaaacagtgctggcagacacacactcaaatctcaatcaatgagctctccagcgagagaaaactcgttagagatttgcttcgaaaatgtcatgcttgagtttttcgtgcaaaaacactcaatcacagttaagccgtcaaaaataattcagtcataaagctcgtcaaaaactcggaaaatcgaatgttgttgtttatgttagaaaggaaaggaaaccattgctttgtgtgagtaaacagtggaaatacgagacaattggtcatacagatgagccaactcattaatgattttttgactgatgagtaacgtgattgacacaactcacgcaggaaaaaattcaatcgtgagttatgagaatagggtcctgaagccctgttccaattttgatgccaaacgcttaagtttaggccaaaaacacatgtttactcaattttctaatgttttccgttggtttaagcccaaaaaacattgttttagattttgtcacatcctttggcttaaactcaaattttgggtgtattttgttttccgtgtcccttacgaaatgtcagataggaacaaccccagtggtcgaactaaaacccctgtggtgtttttgtcgactaagcgaacgtcaaacatgatcaaaagtgtcaaggttcatttaaggaccaaatttttaaattaaagtttaacccattaacgcccgaattatttcacatttatagtaatcacctgattctttctggagtatcgcattatgataagagaatacttaaaccgtcatttaaatggaaatctacggtcacattttgtcacagtacacagtgggtcatatgtacgcaaaatattgaaaaaaattaaaatacttgattatttttgcaaatgtttgaaggtagtatggtgcattaaaaagtgacaagatattatgacaaacattatgtaaacggtaagaacatgataccataagtataaataacaaaacgaggcttaattgaaaactacaccacaaaatgatgctgaatgtgacacgcgtacgaaacacacacacacgatcacatacacgtacatgcacaacacaaactcgtttgtacatacaaacatgcatacattcatacacatatagccgcagtagttgcattttcctcctttattttacgccaggctcgtttgtatcaaatggttacggggtacacacttatacaaatttccacgaatatgatattttttgtcgtaataaaaatcactcaggatttagcgggattcccaacaattacatattgtttctacagaaatcctgaaggcttcgcacagaattccaacaggattccctcaggattcttgaagaatatcacaaaatccacattgcattaattccaggatgctcatgaaaaaacacactgaattctcattatgttgataattcccgcagtatttctacacaatacccaaataattcttacaattgactcttaccaataagaccaatccaaattcccaaagtatttctacgtgattctctcaggaatactaactgtttgccatataactataaaacaagatttcgacatcacaagaatctcagcattctcgttagattcccaatgtttttgctcactattttcgcatttttttttacgaaatttgtacagactgcataactccaacaggattccctcagtatatcattgggttaccatttaacaattcccactggaatgccagaatcctcactggaatacaagcatctacactagaatcccaaaatctacactagaaatccatgatctatgctgaaatccaaagatccacgctggaattcaagaatctacactggaaactcaaactcttcactggtatccatcaatgaaaccctaggatccacatctgaaatccatactggaatatcccaggatccccagtgaatttcaaagatctacactgaaaatgcattatcttcattggtgttcaaatatcaacactgaaatcctaaaatccacactgaaatcccagcattcacattggaaaccaaggacccatgttctaatcctgcggttcacactaaaattgcaaggtccatcaatcctgaaaacccaaggtccctactgaaatctcaggtttcacattgaatttacacgacccatgttacaatcccaggatctaaactggaattcacggattcaattccaggaatttcaatatccacaatggaatactaagattcggaacaacagtcccaagatatacacaaaaatacaacaaacctagtggaattctaatatccacattagataccagggatccacaatgcagcaacacaatctacactagaatcctatgatccacactgaacacttggaatcagactggaacaccaggatccacattgtaattccaggatccacactggattccaagaatcaacactaaattcctagaatccacactgggtttcgtaaaatccacactggattcccagaatccacactggattcccagaatccacattgtattcccagaatttatactggatttcaagaatccacactggattcccagaatccacactggattcccagaatccacacgggattcccagaatctacactacaatcttagcgtccacaatgaaaccctacgatccacactataactccaggattcacactggaatcccaggattccgcactggaaaccctggatccacattggaatcccaggatatattctgaaatctcagaattcactctggaatcccggaatccacactgacttccggcacaggaaccattctataattgttcaggaatctctgatttgcaaaccacgcttatggtagtataagacgagcgtggtgatgccgacaagagctggagacaaaacagaaatgtttcatgctgatagcgcaacctagaggaagaaatatgaattaaaaaacctgacgaattccatccagaatgagtcgaaaaaaataaaaatcgtgctcgatagtcttcgatttggattaaattttgcatatgtttttggtatggtagaataagtgttttccatagaaaaattgatcattttgactcaagcgtaacttttgaaaatggcctataaattattgcatgcaacttatttgcaatactctaactctgaaactgttgatttaagagaaaaatgttctatgaagaagttgtagtgaaccatttgaactataagaaaaaaatatacactgaaaaaatattttatttattttcataaaaaaatcgaaaataaaatttgaattttaaattacacaaaaactccattattaatattttttaaattttcaccatagaatcttgatagtaaaaagatgcttgggacaaagtttcatgatggagaaatttttaataaaaaagtttttctaagaacaacttttggtcgattttcaaaattttgatttttgtcaaaataaatacgttctgatgatacagtaagcatcttgaaatgattccaggccataatgattatatgaataatttctctagaagtagccattttcgatttgtatcgagtttaatgcaaaaatattgtttaaatattaaaataggtcattttcattagttattcgtgattctcgatcaagaaaaataagtaagtggaatgaaatacggtctttactctcgaaaacgtactattattaatggagaaacgcgaataacttatgtaaatggcctattttaatatttaaacaatattttttgcattaaactcgatttaattcgaaaatggctacatctagagaaattattcatacaatcattatggcttagaatcatttcaagatacttactgtatcatcaaaacgaatttatttcgacaaaaaatcaaaattttgaaaatcgaccaaaagttgttcttagaaaaaaatttttattaaaaatttctccatcatgaaactttgtcccaagcatctttttactatcaagattctatggtgaaaatttaaaaaaatttcaaaatggggtttttgtgtaatttaaaatttaagttttatatttgatttttctatgaaaataaacaaaatatttttcagtgtatatttttttcttatagtccaaatggttctctacaacttcttcatagaacatttttctctgaaatcaacagtttcggagttagaatttttcaaataagatgcaaacaataatttataggccattttcaaaagttacgcttgagtcaaaatgatcaatttttctatggaaaacacttattctaccataccaaaaatatgtgaaaaaatttaatccaaatcgaagatggtcgagttctgtgactgaccgatttgacatggaatccgtcacctatcattagactgcccataatgtctttcacaactttgtcaaagataccaaccatccattttgtctaaaaaattaactgtattcagaaatgttactgatctcaaaatagatcactgggcgttcgaggcatctgatctcaaaatagatcactgggcgttaatgggttaaacatgatatagccattatttgagcaggaaaaattgctaaagtagttacagtaacatgctttttcatgttattaaataaaaacaagatttcattaaaaattttaggacccaatttgagcttctcacaacactggttcgaaactgttagagtgcgattagaagtccaaagattagagagtatgtttctatcgactgaatctcgactcactttcgactttctttcgatttcattttgtaacattctccgtgtgaataacaattgagattaagatggggtctatgactaattttaaaccaagaccaatggttgttgaatgatagtaactggggatcatccaaaaatgacgtccatcattagggggaggggggggtctacgaaagtgtgacagtacgtgtagaaggtattggaaaaagcgtgacagaggggggagggggggtctagaaatctcaaaaaacgatggacgtcatatttgaatcgtcccctgcaggaaaggagtaaatgtgcccgaagaaattaatagagagagtgaagaaaatctaaaaatgatttcagaaattagctctggtagaactccttaggccttgtgtatgataatcaaaagaagttttgtttgaatacgtttcttagggaaggattttgaaaaatttatagaagatattcaagcaaaatcgttgaggaactttccattgataaaaatgtattactaattataaataatatgaaacaagaaactacttggcgctcgtgctgtccctctacattatttgtcattatctcctcaacagcttactcttctctattctaaaacttactgttaattacttactcagtgtaccctactatagaaacgaaatcttgtctgcgaatgcaaaacgtcggtcttgaatgatggatagacaggtgcagtaatcaccgccaaatgcctctccatccaactgtcagcccccctagagacacatctcctttgattgattgcccgcttaactttcaagcttcgaccttgaaccagttattctaatctctgtctctctctctctctctctcttctccaccgttccagatctgtcaccatggagtgttcgtcgccgaaccggtccacttcggcgcagcttcagcgaacgctcctcgccaccacgcgtcacctctttcaacggtactagcgatctccagcagcgacagaagtcgaactttctcgacacgatggcactgcgagggaaacacactcgagcagacgcaagggccgtgtttgacgaagaaacactgtcttcatcgtcgtacagctcgtccaccgggagctcaagtgggactctaaccaacggaaggatgcggccacgagtccctccgccaccaccgcctccagccagttcaactggatcatcctccccggaccagcaatcaattatcagcagtgaaaccgagactctaacaaaaaacggaaacaagtcctccgatcaagatgactccaatgtgtacgaggatttttgctttgacctgagctccggatcggaacgaagcagcggacggagctcaaccgcctcgaggaccgtagttcaggtttcaacccctatcccgaccaccttcagtaaggatgccgtccaccgactggagattcgccatgaggacgaagacagcagctacgaatcgatgggccagaagaagacctcaatcatgatcaccggagacgattgctactccacggtcaacgtggacgacgacaacgagacacctctgtaccaatcatccgtagtcgttaacgacgtgtttctctcacccggcatccttcaaacgtcattcaacacggttacgatcagcgtcaactcgccaacatccaccctccaacaccctcgcaacaagcgatccgatcaggacgaactgatctccatcaacaaccaaaagaacacctttctcaacgggtccaactcgacctcgatcatcccgatcggtggatccacatccgtaacggttatgaccccacccgaaacatccgagccaacgactcccatcaagtccaccggcaaaactctcatcagcttagactttgatcgcaaaatgtccagcatgcgcgactccaccggcccggaaagctccgtcgacgacgaaccagagacccaaccatcatcaccagcttcgatcccatccaacgcaaaagacacgatttcgatagttcctaacgaagaaaattccaaagatagtagcgatagtttcgagatgctcctgcgtaatccggtcgaagcggtcaagcgcaatctggtcccacatttctgcggtaaagtcaaggagagccaagggggtgatgttgtttcggctgatgggatgaatggtgatggggcggttgtagttcgccgacagaagaattccgatgtacatttgaaggcccagcggaatagttttatagcgaagctgctggaagatccgatgctgggtcatttggctgaagggctggactatgaactggtggccaagctgatagagaactcgttgctgcggttgaaggaaagtcgaaaccaactggacatgagcggaaccaaagaccaggatgatgtgtcgaagatgatcgaggagtcattgatgatgatacaggaggagcgaagcaaattggaggccaagaaggtggagaaggacagtaaacgaagtagtatcagttcggggaatagttatggatcggcggcgtatgaattgatggaatttgatgcaactggggacttgagcgattgctatcagagctgttcgagtgatctgactgtggatgatgatgcaaattcgtcgcggagtaagttctaccagatgctggtggacgctacgcttagcgagatcgagattagtacggcaaacgacgatgaccatcactacgaatctattaggttgaacagcgatccgatatacgaggaaatcagtgatatccctcctcctctcccgttgacggctccaccgatggttgacgacattgatcgcgaaaagcggaatgctcgatcgatcttcgaaggagcatccaagtacgacatcctatcgtatctggtcgacgctaaagagcgtggaatcgctcaagaggaagcgtacagcttccaattcggtaatgccagtgacatcatcctagaagaggaagaagacgagaacatcaccgatctgcggcatcatcagcgacagatctccgatatcagcagccgtctgtcgcacatctccaacatcagcgactccagtgaagacacctcgctcctatcgacgaatctcgcccagcgcaaggcttccgagattgagcggaacgattccggagtgggatcggaaacgagtaagacctcacgcagtaagtggcagcacccttcgtcctccctcatggacaagatcagtccgattcacctctgcgaagactgcgacggcccggtagaaactcagatcaccgaatccggagtcatgtatgctcccctcgtatgcaggaagtgcggtaagaagcgagccgagcgtaaggagatcatcaccgaaatagtcgaaacggaggagaagtacggacgcgatctgcagatcatcctggaggagttctaccagccgatgctggtggctggactgctgaaccaagaccaactctctgcaatctttttgaacgtggaagaattgctcgagaacaatcaatttctggcggagcggatgcgagacgcactggacatcgctacggaacagggcgacgaagatctactgacggtcaacgtggggaaggtgtttctggaagctgccccgatgctgcacgcttttgagagttactgcgtgcggcaaggaggagccagcttgctgttggctaaccttgagaaggagaaggagttgttgaggatctttctgagggtgtcgcagatggagaacgccgtgttgagacggatgaatctgaactcgtttttgatggtaagtatgatcgatatgaagagcgggtgatgaaggaatttcacacgattcttgttttaggtccccgttcaacgagtcacgaagtatccccttttgcttgcccgactgtacaaagtaacaccgacgcatctggaaggtaaagaacagctgaaacaggcgcaggaaaagatcgaactgcatctgaatcacatgaatcgggaagccaaggacgttccgacgaaactctggcgaaggatctcgtcatccaatccgggaggtcgacggttatcttgtgaactcgatatgatcaacatcaagttgaggaagatggcaatagatgttctggagtggaatacggaagaggttcgattcgccatcgagggaaggctactgttcacgcagccgaacgatggaaactggaagaagagccgtaccatcaagctgacctcgatcaacgctctgctggtgaccaatggaaaggtatgtctatagctatacagtcaactcttcataacttgataatgaagggaccatcgaattagggaggtatcgagttatagagtacaaaatcagtgcaatcgcaatccaaggaccatcgagttatccatgagaaacaacttttactgtggtctctaactcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 145 - DNA, 4863 bp, Aedes aegypti
tggccgctccgcgcggctttcgtggcgcggtgggatgaaaccaggcgcgacgcgaaaagggcggtaaacacatattacacatcccgtttcctccgcgagaggggcgcggaattctcaatgctggaacctcttgcgtcttttcggttcgaaccgatctccgtccgcagaacgaactctttttgtttaaaaagcaaggagatgaaaaaataattaacagaaagaaaacgagcaaaggaaaacgcgctagctggctgcatctctgccttcgactcctccatcctagcccccaacatacgaagtgatgggctgaccttctcctactttcaccctccttgcgtagctcatcatccactcgtacccttctcactgttgtggtttacctcaaaccgtgctcctctcaagctccccaacaacccaaaccgaacgaagaaagaacgaagatgagaaatatttttatacatatcataaaaaaatcaatttccgctgaaaacctgaactagcggatgttatttgaatacacttcatctcactgtgcctgctctccagccatctcccgagtcccgacgactcaccggtgcttcgttcgctccatttggctctatgcacatacacactacaaactcattcgctcacgcggcacctcctaccgtgaccgattcgttcggccaaagcactccactccccacgcagcctactctgacctgcctctgctgtctgtctatcctgtcctgtcgcctgttgatgcccctcattctatcttcgtgtgtatgtcatgcagtagttctccagcaaaaggctactctgtttcttcgttgggacgacagagcagcagcagcatcttcgctcaatcttccatgcctactctgttttgtccaagccgcacgtgcatacacagagcagtcgcacagtaagcggtggaagacacgagagagagaggagaaaatcgcctcgggacagtccccatttcccggattgcctttccgctcctgtcgtaatgaaattatgatctggccaccgcaaagatcaagcgtcctcggcgggatgtgagaaaattatctcattatagaacaagtttccctatacatgtacggggttcacttttaccttgaatcaactcgttccgaaaccaactcaaccgagatactaattgtccgttgtcctttctttcttttacagaagccgaccgaacctaacaacagcaagatgaagctgctaccgataccgttgtcaccgttgaatcctccagcaccgctcggaatatggggttcggatctgctttggcggtatcctccagcaccacccagcccactggctgacctcaagacccaactgccaccacagctgaacaccgacccacggatttggggtcgcgaagaggttgccgtattcttacggttctgtgagcgagaattcgatctacccaaatttgacctggacctgtttcaaatgaatggcaaagctctctgtgtcctgaccaagaacgacctggcggaacgtagccccggtgccggagatgtcctacataacgttctgcagatgctcgttcgtgatgctcagacgctacatcgccatctaccgagcagtcccgtaactccgactagccgttatcccctgtcacctcacagccatcctccaaccccgaactggagcgctctggcacctcccgacagtcccttcttccatagtaaccatttgcagcagttcatggccgcatcaaactccgttacccttagtccagcgccatctatcgactcacaggccggaagccctccacagagccaccaagagcagctacagaacgtgttccaaaaatcctccagcagcagtagtagtactcacacgcaaaacagcaactcgggaggaagcagcaaccaatccgactcggatgaggacaacaccactgccagataccatccccttccgctgtcccacccagatagcaaactccctctactcacccagcaaaatcaaagccctccactaactccaatctcgaaggaaacgcaacatctgggtcagctgcagctactggacaccaagacgctccagtacccggtttctgccctgttgaacaacagttccagcactaacagcagcaacggtatcaccagcaccagcaacggcaacacccatggaagcagcaatggcagcagtacctcccacagcaacggctcatccggagcctccaatggccactcgctgagcttgaaatcgccaactctgtcgccaccatccagttcttccccgactggatcgtcttcggcacccaatacacctggagcgttccttccggttaagcgagaattcttcccagaaggtcctgaacccaacacaagtaagtagcatagctcaatcgaactcctcgaacacttctaactgatttcactcttcgttttccagatggaaggttactgtgggacttcctgcagcaactgttgaacgatccttcccaacgctacagcagctacattgcgtggaagtgccgtgacaccggcgtcttcaagatcgtcgacccggctggattggccaaactgtggggcaaacagaagaaccacctctcgatgaactacgacaaaatgtcccgggcattgcggtactactaccgtgtcaacatcctgcggaaggtgcagggcgaacggcactgttaccagtaagcaccaaccaccgtttcaacaatcaacattttctaaaccgtttttcctcttccaacagattcctccgcaacccgacggagctgaagagcatcaagaacatttccctacttcgccaaacgatggccagtcaaagcgcaaacgggcaatccggaccaacggccggcagtgctagcagccactcgctgatgtcactcctgccgaacggtgctaacattcaccacttggctgctgcagccgcggccgccgctgcctcccatcatcaatcgaacggaggcgctccgatttcgcccaccgcgctacaccatccacaccacccatcgcaatcgtcagtacaaagctcggcgtcctccaatggcgtcgtcaacggccaccacatcaagatggagaccgatctcgacgaaatgaaacccaccgatctgagcacaagcgatcgcaaatactacggcagcggatcgaacggagttgactgttacccgtaagttcttcacttaaaagaccgtcagcaccaaccatagctaacgaatttgcttccatccacttccacagattgattcggaacgcgaacggtttgaccaccatccagttgctccgccaacagcaggcgcaacactctcaagagaacagttcacctccaccgtctcccagtcacctgtcgctcaactcccaatccctgcacaccatcagcagcaatctgcaccacttgcaccaacagcaactgcaagcacaagctgccgccgcggcagcagccgttgctgcagctgaggcaagacaccaacagcacagccaacaggatgacgatcacaggctggaacagctggaacatgaccgggagcacgatcgggatcggagtccctcgcctgccgaccaccaccagcagcagcaccatcaccataccggcaaagccagcgacgatgagagcatgatgcccacggatctcagcaaatccgactccatgtactacaaataaggcaaatgattccaccattcatttggcaacactgttgtgacaatcatcgtacacagaggagacgctgcgacggatgatagcctgtgctaacggacctcagccagagaccggcgtaacgagagatctcagcaaccaccggtgccatccttccatttacggtagagcgaaaaggcgatctcatcggctgcggtcctctcatcagctaccttccatcttccgtgtgtttatcacaaatgactgaacaaaaaaaaaatataaaaaagaattaaaaacgtgtgatagaaacaaaacggcggaaattgtaaagaaacaaatatccggaacggaaaaaaaaaaaaacaaatgtgccaatcgttctcattattgctatcgtttcagagtttaatcattcatgagtgggtttgcctctcgcagatcgattgttatcgctgcggaagaaaggccaatattcagttcgaaaatgtacagacacacaaacacacttgagagaaagtagttgaatatcctgccctattaacacggatgggtttcgcggaaaagggaaaatcttttcagttttcttgtattatatgactaaacaaaattttgcgttcgaaaagtagaatttttatccaggatatcgagtatagctaatgaggttttcgatttaaagcgtagagaaaaagatagagagaaagcgacgggagataaataggttatgttgttgacggatgcgaacgggagtgcaaattgtgtacagtttttttttactcgtagaagtagagttcaccctattttttgtgacaacaccctagcagttaagcggttgatccagccaggataaaagtactcatttagatttttcttcttccaacgacacatgtttatcggtttgcgtgaagtattttttgttttgtttagaaagaaaagaaaaacacacatagtaggctaagttcgagaactttctttcacaattggcttccattcaccgatagaattattaaatttacaaaatttgaacaaatgtgatgaaaacatagaggtttataattgaagaaattttaacgaaatattataggtttttttttttgtttgcggcacgatgaaaatgatgtgtgagtttataatggtattatttagcggattttttgttggtttgaagaaaaaagggtcgaatttgttttactacaattagtggaatattctctacttctttttgttggctttaaatggaaatcgaaatcttccttatttttacactag

SEQ ID NO: 146 - DNA, 5027 bp, Aedes aegypti
gtacgaacatttttattccatgtgttttttaacgattaaacaattatgctcgttgtccagtttaggactgaagccctaaaagtgattcacttcctcggcgagatattttgacatttctttatttactttttggctggcgcacaactcggcgcatgggccaccggcgcgcaacttgttggacagtctgcggattaaagtaaagattcgcaatagttgcaagaacatgctctttcgtattgtaaattaaaaacaagaattcattaaacattttaggacccaatttggcaaatatttgcacatttggcaatgtgtgtactgatagctttatgcgtcggcgaagcaccaaattagaatgccgacgccgaacttcgccgaagttttgactgccgaacttctaattgtcacttgaattgacaataccagaccatggcacgtattaacattcgaagtcaagaggaagtgatcgaaatgctaaaaattctcgagaagctcaatatgctcatttttctccgtgttacgcacactatcgaaagatgatgacgaatggagtaccttaatgatctggccttggtttgatgcgtttaaattttaaagtctggaaaagtgcacacaaacgcgaaacgcgatggcgtccgtcaactcgataaatattcacgaattaaacatcccaaacctggaaaaaatcgaaaactttttcaatgactccgcgtacaaggaagcgatcgaaaacagtgaaacattcaacacccgtttgtgcatcgaaagacggctccggatgccatttctggatccgcaaaccggagttgctcaatatcatagcagcttgttctttagggccaggcaaaggattccagggttgaaggaaggacaaatctacagttacccttcggcgcgatggcgaaagtcccggcggcagtacttaatgcagaaacctcagccaccatttccgacctacacgcacagaccgtttggacatttgcaaagtgcgtacgattcggaaaactccaatctagactcagctgccgtagccagtgttgaaccggaaacgaaagaccacaaagatgaccctggcaaggattggtattacgacgagatggatatgcatgaattggaatcttacgacgatcacgatttgccggattcggactgtgatttcgaggagagctacagcagccgaaagaagaaaggaaaaagctccaagggcgggtccagttcttcaaaaagcaaaactagcagtattaatgatccgaacgctcagaaaaagggacgaaatccgggaggaagaggtcgtggtagaaaatcacagggcgttggcgatagtccgacaacacccaaggaagcaggcgaaaattccaagaagaatcgatctcagacacttccccatttgactccccagacgagttcttcgcctttaaccgtacctcctgttgaggaaccgccaatgccggttttggtgcccgaaacaaaggtccccgaggaaccagaagagattattccgattaaaccgggaatatctgtcggtggaagcaatgcatcttccaatgcgccatcgcctgttcccccaatcgaaaaaggccgagcgattccgtctccatactgtgacttctgtctgggtgatgctcgggaaaacaaaaagacactcgaaccggaagaactcgtttcctgttcggattgtggccgctcggggcatccgacgtgtttgcagttcactgccaatatgataatttcggtccggaagtaccgctggcagtgcatagaatgtaaatattgtacgatttgcggaacttcggacaacgacgaccagctgctgttctgtgacgattgcgaccgtggctatcatatgtattgcctgtcgcctcctcttttaaccccaccggaaggatcatggagctgtaaactatgcacagaagagttccacaaaaaataggctttattcaagggtgagtgttttatttatttattatagccctttagggaggagtcctctaagcccggacactttttgttttatggtgatatttcaaaatcttcattagttttactgtttatttttgtacagtctaaaaaattgtcaatattttaggtaaaaataacatgagaaaaaaaaacctttacaattcaggtcagtcagtcaaggtcagttctataaactccctaatgatcagcgccatagatagattctccatatcagtcgtatgttgcactagcggttagggtttgttcacaaatatcataacgctaaaaatggccattttcgacacccacccaccccctcgtaacgctttttgtatgaatattttacaaattttgtatgagccgtaacagcacgaggacacccacccacccccttcagcgttatgaaatttgtgaatgggcccttactcgtattcaggtgaaaatgtcttcgggaattcaacgcgtttttgttgttcttgaccatttctttgtcagctcgaaggttttttatgtagtcttgaagtgtgctcttaggtacagtcaactctctcttactcgacctccgtatctcaatatctagttagaggatcatagtaaaatttggtgttcatggctacctcgatggtcccttgaatcgcatttgcactgaattagtgttctgtaactcgatggtccctccattatcgagttatggagaggactgtacatgatatcttgtgtctgcttcccgtgcgctcattggctcaaaagcacttacagcactttataaggcctctaaaatctaaaagtttagttatttatgttctataaaatcgtttattagcttgtagtaatagtaaatcgtcactcaacgagcaagaaataacattgatactgagaaataggaattgaaaatgtggtgaataatattcaaatctaattttctcagagtcaacgatctgaggaatggtccttatgaattgttacgcgagaattgagattttagcgaaggaagacgcgacccatatttgtgactaataaaattgatttttatccacacgagttgtacacattcaaacatgtcggagagtgtttctattcgccccattttacggtataaggttaacattttcactgtctggtcatagaggacaagaggtgtccggtcatagaggacttgcaatggtttcacagaaaggttgcttttgttttaaatttttcagtttctaataaattttgcattgtgattgatgcaaaacttactgaagtcaacgtacggagacaatttagcttaaattattagaaacatttgtggctacacttgtatgaaattttctcgttttacattttttcaatagatcgaattagggtgatacttttgacagtttcgctcatgaaggctttcttcaaaaaaatgtgaggtgtcagatcatcttcttggcacttttgattcacttcggcaggaggttttttcttcaatccgatgatggcaatccataacatgcgggacatcaatgtttcaaattgagtactttcttgcaaaatggggtcaactacaagtgcttccgaaatgttctggagacgattccgggaccctgcttaggattatactcccggcgaaaaacattgaagattgaaatgctgcatgatatggttcgcaatcatcggatgaatgtgacacttggagattgatgtgccgcttgatatgaattgcaatcatcggattaatgtccttctccagggtccggaatcggctcgagaacatcccggaaatacttgtaataaccctatgttgcaataaattactcaatttgcataatataacattcctggttaaaaatcttgaagattgatgtgtcacatgatatggttaccggaactggtcagaatggttccaaatgagttggaatatactaatggtgtaagatttagtaacaaacactgtagttttgtttgatccgtgcaaaataattatgggaatgtctcaaatgtccttcggacatacgccacggaacatccgtataaatctaaaaccaaccgcccgacaggagatcccagtacagatcacgcaacttgtgtcaaaattttagcggaatcggctgaacattatggaaattataaccaaaagatcacaaaaatttgattgtataaataggtcagggaccttcataagtcgatgttccatgactcgatatcaactcatggaaccatattagaaaacaaatttaatggttactatgatggtccttttaaaaagctttccaaaggattactgttccatgactcgatatttctatgagtcgatgatcccttcaaaatcgactcatggaggtttcactgtagaactatttcaatattctcctataatcatgtaaaggtttgactgctttcaacatttcgtactaatattcttgcattttattttcaattcacagaaattcggcagcatgacatgtttagaatctaggaatgaaataatctcttctcctgcaatggacgaaaatattcgataattgtgaaggtattagtactcagtaagtaagatatgctattaatcttataaagactaaagaccagtatatggcagatagtaattgcttcatattgtgtgatgctattatagttcgatgtaaaatttataaacctaaacattcagaataaaccatgaaaaatatataataaccttttccgtttatatcacagcatgattttttgacttcttaggctagctttattacgtgatataatgagcttgttgaacaaattgttccgagtataaattacacaaaaaaatggttgttttttaatgtcaatagggcggaaaggcacaaacggattttcagttttttgccatcattagaaagataatctttttttctgtttatggtgaaaaaactgtgacgatattttatttttgaagaaattgaaaatattttgaaaattatgtttttaaacgaaaatcgtacataacttgaaaaataatcgcgattgctctttggtaccttcagcaaaaatgtgcaacattgaaagttctaaaagtgtttcatacaaagtattcaaaaaaaaaccgcttcaagatatattcaccatag

SEQ ID NO: 147 - DNA, 84017 bp, Aedes aegypti; identical to SEQ ID NO: 67

SEQ ID NO: 148 - DNA, 16386 bp, Aedes aegypti
  misc_feature (1975)..(2074): n is a, c, g, or t
agtaaaggcgtttctctttttatgcttttctgtttcctagcactgttatcaagcctcttgttggtgacttggtcactatattaatgcaagatgcttaaaatttaacttaagccgtttaatggctttcaattaatggtcgctgaaatatcttttttttccaataaattctgacgaggataaattgtaaggaaacttctaaaaaaaaacaagtttcccaactgtagattgcaaacttcacgtgcttggcagctttattgaaaattccttcgtttataagctcaggttcctatagttatcaaagttggaaaacagtgaactaaaagctcattagaaaatacaataaaatgcacaaatcaatgcaattactggatgacttcatatactactatcttatcgtcgtaggctcaattgaacgacccacatcctacaacttgtgcttcgaattatgtcaatagaacacaagtccattatctgtttgatctcgcttatcaactgttatctgcactctctgtaatcatcattacctgtatcaatatacagccaaacgagcattaaaaaccccagtaacttaagtaaagtattctccttcccgcaggtgatcacgagtgggcaccagacacacaccagtatttcctagcgagaagaacgacgcgagaaccaacctcaacggaaaaatccaggcgccatgcctcatcggaatccgtcaagcgcgcaacgtaggccaaccactggggctacgtacgaaacctgaaggctgtgttaagaaaaattgtcgctatcgaagttattagcgaaatgaagttctagcattaggtttatagtgagttatataacatttgtgaaatcagctgtcgaaattttccaagaatctaaaatcgttggagcgggtgcgaaaaacgtctccaaaagtgtccattccggaaatcgtgtagaaaacgtgatcgagtatcggaaagtagctgtttgaacagcagagcagaaaatgctgaattccatttcgaagcatctgctgcactgcgcgttgctcatcacgttgcttatatttttcgaagtgttttccggcggaataaaagtcaacgagaacagctttgtgtcggtggatccttgggaagagtatggcacgataccgaccattctgctgtacacgttacggttgcttacattcctcacgttgccccaggtgctgttcaacttcttcggcctggtgttctacaatgccttcccggagaaggtagtactgaaagggtcgcccctgttggcgcccttcatctgcattcgggtcgtaacccgaggtgactatcccgatctagtcaaatcgaacgtcatgcgaaatatgaacacctgtttggatacagggttggaaaatttcctcatcgaagtcgttaccgataaaccggtgaatctgcagaagcatcgccgaacacgggagattgtcgtcccgaaagattacaaaaccaaaaccggtgcactgttcaaatcgcgagctctgcagtattgcttagaagacagcgtaaatgtacttaacaataacgattgggtggtgcatttggacgaggaaacgctgctgaccgaaaacagcgttcgtggaatcatcaatttcgtgctggatggaaagcatcccttcggacaaggactgattacttatgccaacgagaatgtggtgaactggctcacgacgttggcagacagcttccgcgtgtcggatgatatgggcaagctgcgattgcagttcaaaatgttccataaaccgttcttcagctggaagggtagctacgtggttactcacgtaagtttcatgagctatggcttcaacattattaaatagaaaagtttccagtagttctgtagggttttgagtaagcctgagtgattaagggtttaaactttcaacacagacaaacagacgtaacacttagaacaaatttcaatctgaatcatagtctcgaggacatgtacgctattttaaaatccggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattaggaaatccattcaaaattgtcaacatatggcctggcatttcatgattgtatccaagtcttttattaacaatcttggtggataacttgaaagcgctcgatagattcttggttccatgtttcatttgtgataaagtctgggattatttttgcgaatatcgttactgctcataaagaccacatggataaagtaggcattgataaaatagcgctcaaattatgaagtttgtcttttcacgtaaatgttcccaattttctagtacatttctgcatgccatattcatttagcataaccgcagagataactcatttggcttctgttgatcagcaaaaaatataaacttgaacagatttcaccttttacagttgctcttggggttgcaagttcatgtagtgactgttatatctttgtttttttttttttaatgaggctgcatcagcttcatagttttccacaacattttcaaacaaagtgttgtaattttcacatgcgtagtaaagaatatattgaaacatgaatgttgtgaaaaaaaggtgttggttcaaaaatccatatgggacagttatgcttttatgggcaaattagtagtccctgaaaagattctcaaaggattacaataggcctctgtactgttttgattttgcatgggattttgacttttactggccttgttgtttaccagtttcatggaagagtgaaaagaagaggtacatttttgtgcagagccccatagcgggttgccaataatacttcagacggaatccttacttttgtgatactttgaaagtgctttacatgattctcaaggtattccaaacttgatatttgccggacctatgacatgatctttagaatatttgtgttgataccttgacagattaggatctttggataccaaggcacatattcggaaaattactgaaaaaaatcaaatggactgcccatactcgtataactgtcccatattctatggaatttcctatataaatgggactgttatgcgagtatgggcagtagagtccttggaaaatattttgattgcttccatagtccttaacggcaaaaacatgttttaaaaatttgtcggcagactcatggtatattgtctttcaatatgtttcttactttggatttactcgaccacatgattataatttaggtatatcctaaattttcataaactttttattaggtttttaaaacgatagttttttgacaaagccacggaatgtttgtagaatctcaaagggtatcggggaaccaatgatccagcaggtttcttctccgagactagtcctcatttcactgtactgtccataactgcatatttgaaacattcgacaaaagtaggcattgaataaatggtataccaagtttgcattttactgcagtatgggaggaaactatttttttccttcttagcaatggggggataatctgctcaacagaccctgcgtagccatgcagcaacgaacatcgatgacacgcttagcggggtccaccaaggtagcatgctgccgctttgccagcttcccaggtggtccttacctcccattgtccgctgaaggcgggcagggtcaaccacaacgcccgcgcctagctgcaccgcaggtatcaagaactgatactgcgggctccgcaatttgacctactgaaggctcaggccctatcagctagcaccagctgggattgctgtcgaaggggcctccatctgccccgaacaaccagaggctcgtatccaacccagtaggccgacgccacgacagcaacgctaccaggatgttctccccgcggccacttaatcgcgagtaatggtcgatttcgaccgtagggcaccggtatgacctacgtagcggactgcgaacccttggaccacctgttgcttagcgtctgcactagccactcctcgagtccactcgccacctcctttgaaagttccaacacgatgtgagtgatagccgatgaaacgacattccagccaagctcgtcttcacacatcctctgaaccagattgtccggagtcgtgtccccaccgcatgtggcaaacatgcggtcacgcatggtgcggaaacgcgggcacacgaacaaaacgtgtcccgccgtttcctctaaacttgcacaagctggacattcggaagaacccgcatggccgaaacggtgtagatactaaagcagccatgacccggctggccagaagcttacgcttaatggcgaacaccgcagagctattgaacatcatccgggacagtgccacaatagctgtggaggctctcttgcaggcataatcaacgtggctaccgaaggtaagcttatcgtcgatcatcatccccaagtgtttgacagagcgcttcgaagtgatcgtgcagtcgcctacactgatcaccgcttgctgcaccgactttcggttgttgacaacaaccgcctcagttttttggtgagccaattccagtttcctggagctcatccacttttccacaattgcgatcgagtgggctgcagtcaattccacttcttcgatcaattcaccgtagacctccagcgtaatatcgtcggcaaagcctacgatgaccacacccgccgggaattttaatctcaacacctcgtcatacatgacattccataacaccggacccaggatggaaccttgcgggactcctgaggttatgtgaaagcacttccgacccacctccgtgtcatagactaatacccgattctggaagtaacttccgagaatattgtactcgggtatccccagacgcaggagcgcatcagcaatagctgcccaactggcactattaaatgcgttccttacatccagagtcactactgcgcagtagcgaatacccctcctcttatgctggagtgctatctcagcggttttcttaactgtcagaatagcgtctacggtggacctccctttccggaagccgaactggttgcttgagagaccatttacaccctcagtgtacctcaacagtctgttgaggatgatcttctcgagcaccttccccaccgtgtcaatcaagaatattggtctatacgccgacgggtcaccgggtggtttccccgcctttggcaatagtaccaggctctgcctcttccacacatctggaaatactccctcgtccaggcatatctgcatagcagatctgaacataccgggagcctccaagattgcgactttgagggccaggttttgagggcctcggaactccgtccggacctggtgccttccccatgcttagggattttgcaatccctacaagttcttcatcggttaccctatcctcatcgccagccccaatccccggctgtcctacgaaaggaggccatgggctagggttgtggcgtggagtacttggactcttccgtcttgatgatgatcgcatcacccttttcgcgcttggcacttaccctcctacctttctttggcctggtatccctgcgctcctgcacttcctgcttctttttcttcttctttctcactactgttgtccagggggcgtccccccctgatctgccctaacctgtggtgattgaggacctctcaaaggtcgcaaccccctattcccatcactccgtgaggggccagccttttcgggcccacccttctcggctttccgggacgcctggctggtgtccggttttcggggttaatatgcgcctagccttgcgagcgccgccgggcagctcctcccctgacggatgcctcgcacgcttctgcgattgcttgttgtaagctttcgcttccgcacttttggggctacccgcgaaaacgaagggctccgtctgggtagacttcggcaccttcaattccactggttctgccgttgccacagtcgccatgggttcagcatggttctgcttggccgccaacatcgacttacgaagtctgaacagggcctgcttgaggtcctttctgatgttagacttcgaggacgcaaagtcaatgatggagtcaagctgctgtgcagccactttcatcgcagaaagcccatctctacttttattgatggccctcatcaaccacgctccatccataacctcacccgatgcgttagccaggaatgaaatatggtttccagcactggcactacgtgcactgctgcctcctcctgcttccactctcctcaacggagacctagctaacccacttcttgctaaggggttcgcttccctactactgctactacctgcactattactattattttgattttggtttgaaattgtactcattttggatcccacgagtagcacgggaaaaaagcccaccacgccagagccctgcattaacgcggtaagggacaaaatactgtgaggggtgcccaggtgccccacaggctccgttaatggccgaacatcttttttaccccttcgaccattcattcctcagcacagtttttcgcttcacaccttgaattggggttaccctgtttggtggactcttaccaccggaaccggtcatccgtagttctattctatgaggtactcgggtatcgccagacgcaagagcgcatcagcaatagccgcccaactagcactaatgaatgcgttccttacatccagagtcactactgcacagtagcgattccccctcctcttacgctggagtgctatctcagcggtttttttaaccgtcagaatagcgtctacggtggacctccctttccggaagccgaactggttgcttgagagaccatttacaccctcggtgtacctcagcagtctgttgaggatgatcttctcgagcaccttccccgccgtgtcgatcaagcatattggtctatacgccgacgggtcaccgggtggttttcccgcctttggcaatagtaccacacagaaaaaaatatttaattttcaatgtgatgtaaactgttgtctactgtaaaaataaatcaaattcgtgtgttgttacagcaccatgtaaatttaaatgaatatacattcaattttcaactaaaaatggttgaatattacatgatcgtgtatatttatagtgaattcgattgaaaaataatggtttggtcgttgaaatttaggtttatttcgatgctccaaatatgtgcatgaaaataaacttaaatttacaacatatttttagctgtgcaggctgtgcctcttccacgcatctggaaatactccctcgtccaggcatatctgcatagcagatctgaacatcccgggagcctccaaaattgcaactttgagggccaggtttggaactccgtgcggacctggtgccttacctatactgaggaattttgcaatccctacaagttcctcatcggttaccctctcctcatcgccagccccaatccggctgtcctacgaaaggaggccaagggctagggttgtggtgcggaaagagcccctcgatgatctcctccagcatctctggagattgctctgtaggagccattgcacctcttgtctttgccataacgatcctgtaggcatcaccccacggattcgcattggaactctgacagagtccctcaaagcaggcctttttgcttgcccttatctcggatttcagcgcgactttggcagcggtgaacaccgcccgtcgatcttcacgctcctctgcagtacgtgatcgctgcatccgtctcctggcccgtagacaggcacggcacaggttcgcaatcgcttgagtccaccagtacgtcggtggtctcccattccaagagtggacttgcctaggcatggtcgcatcgcatgcacgcgagagcaccgcaaccagctcgtccccgcttaggccgagtaagtaacgctcacggcggatcgcctctctaagtacttcgtcattgaagtatgatgtcttccacctacgagggcttggccgtgacctagccggttcctatactcgctgcctgctgttgttgtagtcgatactgtagcgaaccgccaggtggtcactgtgagtgtaggcattgtctaccctccagttcgaactactcgttaggccaggactacaaaaagtaacgtcgataatcgactccgctccgtttcggctgaaggtacttttggtaccaacattagccagatcgacatctagcacggccagtgtctctagcaggatttgacctcgctggttcgtgatacggcttccccattccacggcccaggcattgaagtcacccgctattactactggccttcgccctgtcaacacggtcgtaatgaagtccagcatctgcgtcaaccgctcgttcgaccaactcggaggcgcttagcaactacagaagaggaccccgtttaccttggcgatcacgaagccctcgtaggtagtagacaccaactcctggacggcgtatttacccgtcgtccatatcgccgccattttttcggatctatccacgacccagttgccgttgccggcgggtactcggcatgggtccgatatgatggcgatatccatcccccactcagcaactgcctgatacagcaattgttgagctgcgtcacaatggttcaggttcagctgcgcagtgttgatagactcgcactcaaatgtcaatcaatacgctctcccgagagagcaaactcattagagatctgcttcgcaaatctcacgattgagattttgatgcaaaatcaactcaatcaactcaaaccgtaaaaaatgattcagtcgcaaaacctggccaaaactcgtgaaacccgaatattgttgtttacgttagaaaggattactataattttaccagactaactagaaattattgccgtgggtgagtaaactatggaaatacgagacaatgagtcaaaaaggtcagccaactcatctgtgattttttgactgctgagttgcgtgattgacaactcacgcatgaaaaatctcaagcgtgagttgtgagaaattgagcttttcacaacactgcagctgcgttacctgcactgtgacttttcaattatggctcttttgaaggtcgggtaccttgagcctcccgttgcttgttgttcacagacttcccggaacaaatcaaacacttgggagggttcttgcagcctagtgccttatgaccttcctcaccacatcgcctacacaacttggtcctatcaggacctttacagccccaggacttgtgtcctggttccctacacctgaagcagatcaccggttgctcgtgtatgaccttgatctttcctaccttagcggacttattagcgtcacaggtagctgtactaaggcgaacggcagcggtgggcacctgtgcctcgcactgttgccgcagtgccgtgacgagctcttctgcgtcagtgatctcgtcaagattcatcaccttcagagtcactgcctgcgttagagctctcacctcgataccctcgccaaggacctctccgtcaaacttttgtaggcggcgcccttgcgctccttgtcgcgcttaagctcgaggatcatatcacctgtacgagtgcgtctaacactgcgtacgtcggctcctagatctgcgagcttcgcgtcgctgagcatcgccttcaagacttccgagtagttggactcttccgtcttgataatgatcgcatcacccttttcgcgcttggcacctaccctcctacctttctttggcctggtatccctgcgctcctgcacttcgtgcttcttgttcctcttctttcgctctacggttgtccagggggcgtcctccccctgatccgccctaacctttggtgtttgaggacctatcaatggtcgcaacctgggagggaggcaccgatactacacacgaaatatgacacacacttttccaaatgcagatactcccgctcaccaacgacaatcaaggcaggcttggggaaaatcgttttcttttattgtgtaccttcgatatttctggacaaacttggaaaaagggtcatagttttatgtgcattcaattttaatgatgattggaaaacagtaaaaagatgcgtgtttcattactttatattcgatcaaattaaaaggtactatcgtggcattgcttttgggtgttgcaggaattgattttcaaccgaatgttgtcaactttgttggaatgcaaaaatttgttttgatcaattacgcgcttttatcaagtttgtccattcttcaagatctgggctcacagtgacagttcgtgacagcagaatctcggctcactatgacgtacataaattttgtatcggtttctccctcccatgtcgcaaccccctgtttccatcaatccgtgaggagccagctttttcgggcccaccctcctcagctttccgggacgcctggctggggtctgactttcggggttagattccgcctagccttgcgagcgccgccgggcagctcctcccctgacgactgcctcacacgcttctgcgattgcttgtcataagcattcgcttccgcacttttagggctactagaaaaaacgaagggctccgtctgggtagacttcggcaccttcaattccactgattctgccgctaccacagtcgccatgggttcagcatggttctgcttggccgccaacatcgacttacgaagtctcaacagggcctgtttgaggtccttgctgatgttggacttcgaggacgcaaagtcaatgatggagtcaagctgctgtgcagcaacttccatggcagagaacccatctctactcttattgatagccctcatcaaccacgctccatccataacctcacccgatacgttacccggggatgaaatatggtgtccagaactggctctacgtgcgcaactgcctcctcctgcttccgctctcctcaacggagacctagctaatccggttcgcttccctactactgctacctacgctactagggtaagcgttcccttagttgtgggtgttcctatagttgcggtagtgccgtttacactgattttattacattagccgcagaaccgacactgccaatcgacgtatttgcctgttgatacacggaatagttgaaaagagcgttcaaattgctttaaaactgatgaaatatcactaaaattactaaaactttcaatacctgttccaatagttgcggtaaagtgttcctatagtggaggatcccataagaaaacaacggataccgcaactataggaacacaaattaaaaatataccgcaactaaaggaacagtgtaccaacagtggaggtattatttttcactgacatgccgtggattactgcgatgaaatatttttttctcattaagtcaatggtcgttactacccgttacaacattatcatgtacattaattgcacttcttgaatttaggcggttaaatgaagttcaatcgtgcttagtacctccactattggtacatctaccctactgctattttgatttaaatttgtactcattaaggatcccacgagttgcacgggaaaagaggtccaccacgccagagccctgcattaacgcggtaagggacaaattactgtgaggtgtgcccaggtgccccacaggctccattaacgatcgagcatctttttcaccccctcgaccactcattctttggcttggcacggttttttttttttgcttgaaaccttgaattgcggttaccctgtttggtggactcttatcaccggaacaggtcatccgtagttctattcttagccggaaactacacagcaaaaaaagcttatttgaggctgaaattttgtacaactcatgtcgcatattgggtgaataatcagaaaataattctgatagaaatttcgttgctactacattatgaggctcatgtataatctcaatgtgactgttatgcggttacaattgccaatgagacaaaacaacttggtattttttttttaattttctagaacaatctcacagattttaataagtcgatccaaagtatttatcatttgatgactctccatgatattaactccaatttgtcaaaaatgtcgaatgtgactgttatgcagttatgggcagtgtaagtctctgtttttaataataggtcacttttctacacaaaatttttactgtttttatatttctcaattttacttttactgtttttacaatttctcaagttctactgagtagtgtatgattcttcgacctggttgcttgctcatgcggaagcgttcgacgagagctggatcaaacatgccgcgcgttgttcgcataccacggtggaatagtatcgcgaatcgattgatcttatcgctttgtcctgtagggcgagcaacgaacacttgttcggcgttcaatgcttcaaattatatatttatcgtttaccaaaacgaatgctttacccaaacctttcccatatccaaactcccagtgtctacttgtggaagtgcagaggactccttggcttccataaagcaagtaacaagtcaacatttccctcccatccctaaattgacctgcattcggacgcaaccggcgctgttattgtttgttatgataatgagagcaccagtacttacacattgaggatgctcctgatcccgagtagtgtctgttggttccctgtgtaagtacagctgttctggcaataacgtagtagcatctgcgggcggtcaatcatgctcatgcttttacaatttctcaaattttactgtttttatatgtctcaatgtcttctgatattcgacaggcaaaaaaatcacgaaagcatttttaaccaatttaaactagggtctgtgtagcagtagccgccctgctgagaacaaatacagttaatacagtatctctatatccagttagagaaccatagtagcatttggttttcatgactacctcgacggctttttggatcacatttacactggtttagtgttctttatctagatatctttctaattcaatcgtctcttcaatatcgagttaggctgatacaaatattaattttctgttatgtcacccctcttcaaaaatccgaaaatataggaggcgagaaaaaaagatccatcaattttttggcatcagttaggtatttaaaacttctaaagtaagaaacaggtaatatgacgatcaagaggacggttgaaaaaagttcaacaactaaagtttaaaataaaaaactcgaaaaaataactttttcttcattgttatttttttgttgcttattaatttttatcccccctttcgcaccttccaagtggtctcggacataaaagaaaatttaaatttgtatcagctttatagagagttgactaatttcttaattttaaaaagccggaggtacgttttcctgaaactatttaaaaatacttgatccagtctctctgaacaccgactttttgtctgtgatatgttcctgaatactgcaggtttaactcaaatataaaatagcataattaggtactagattttcccgttttacaattgatttcataactattctttctgatttcaggtccacgctgagaaggaagtctcgttcgacaacgggatcgatggatcggtggccgaagattgtttcttcgcgatgcgcgccttcgccaagggatacacgttcaactttatcgaaggcgaaatgtacgaaaaatctccgttcacgctgctggacttcctgcaacagcggaaacgttggcttcagggaatcctgctcgtcgtccactcgcacaccattcctctgcggaacaagttcttgctgggcattagcgtttactcgtgggtcacgatgcccctgtccacgtcgaatatgatcttcgccggtctgtatcctattccgtgtccgaacgtggtggactttttgtgcgccttcattgccgggttcaacatctacatgtacgttttcggagtgatcaaatcgttttcgctgtaccgttttggtgtggtgaaatttttcgcttgtgttctcggggccttgtgcaccattccgatcaatgtaatcattgaaaacgtggccgttatctgggggctcgttggcaagaagcacaaattttacgtggtgcaaaaggacgtccgggcgcttgttacggtttaatgcgggaattacgtttggataagctttatcggtttaagataggcacatttcctctcgattgtggtaaaaaacgggccatgttcgacgaactacttcattacgctgtcggaaagtaggcttctagggacccataactttttgcgtatgcggaaaagtagaattagtgagttagctgtttatcatgaacatgtatattttatagctcttttatagtattttgcttttctgatacaccagggaaagcttacgtatactttaagtaacgaaagtcatgttgctttgttatctaagaaaatgacgaattagatgttactggaacgaatggttttcgttttacttcacttttctacttagttggaatagtattaatttaagaaaaagtgtcaggagaagggagttgcttcaaatcaggagattttcattgttatttatttttgtgtatattttcttgtagcgatattttgccgtgatagacattttacgtgtaaagttattatatttgagaactatgttctccaaagtgtagaatatgtaattggcatttcctcctggtcgtttacggaaagctgggagtacgctcccgatataagtattcacattcaaatgctacaccatcgtcattaacaggttatcgtttactcaaagcactctcattgggttattcattaaatgttgtttgcatcgcttaacgttccataaaatagtctctcttcggtatgtagacgagaaaatcacgtaaaacaaaaactcgcatcacaatggacaaaactacttacaaacattatgtttcaatgcgcaaaaaatagaacaattgctgctgcattactagaacagaaacttgaaaccgaaaatttaaagcagaacgtagataacttacacacatttaatcgaaattgatagcagatcaaaaacaacctacgtccacacacgttgttcattatctatttaataatatagcaatgatggcaaaagataaatataaaaacggaaacaaaaaaaatcaaaaaactgaactgcatgaaatctagttaataatcgctactataccattgattggaagaaataatagtaaagcaaactcacacaaaactaaaaaccagcaaacagaaattattccagtatcggtagtgttttaggcttaaggaatgtttctatatatttttctatggaaacagccatttgatatgaacggaataacgtaataacgatgagtaccatcatcggatcgtttgtatgttttgtcacgcgaaggatagtttttcttgcgctccttgcatatgatcttatctttgtttgattttcttctaacaattctacgaaatgataacagcgcaacggtgattaattctccagtagatgcattactatgcactacttatcaaatctggtgttctttagaatggaaagtgacacatggcttctaatttagtatcttatttaccaagaaatttaactagtgtgatatagctcactgaactcttagcgatattgttcgcagtgctttctaatattgatttattgaactcgaagatctgttcctactgaaaagcttttcaaatttcattatctactacccgaaaaaagagtattattatcaatgtggtatcatttgacaaagtcttgtttctagttttttcctttcgaagcgtgacataatgtacagacaattcgtcccgaatgcaggattattcgacacaacaacatagatgatataaaacaattgattctacctgtaattgaatttcagatacatattaataaaaacatatgattaaagcacatcgactggtgaggtagcctatcgcgcaaaatggaacaaaaagaaatgcccgtttgtcaaacgaacagttcatcactggggcactgggctactggatgtttcgtgttttccgttgcctaatgttaatgatcgttcaatttgtgcagccttttgctgaagccgatgtaagttgtcttatttaatgtgtcaacgaacaactacattcaattacgattagttgcatgagagttattcacatattacttgatgccttgaataataaaaagtagaacttctctctccaaccgtgaagcaaacaaatggattggatctgttaatactacacccggctctttgcataacccaatagacacgaaagttcatcactctgttgtagtctacggcgggattcaaattcttaccacaattttgcacacaatctatcgttgcactgatcagtcttgtaagctatacacaaccaatgctatctattatgccaccttcaaattgatgaaaaagtgatgcgtttggtcctgatattcatggcattttgtaggatttgtcgatcgatgtctcaaaaaaactcccacaaaccttttttttattagtattgtttctact

SEQ ID NO: 149 - DNA, 27907 bp, Aedes aegypti
gtttggtgggtggtaaatcgagaatggcgagtccctcgccagttaacagccctatgcctccgccccaggcgccgagtccaatggggcctccttcgcaaagccccgccccttccccgtcgccacatagtccctatcaacagccgcagggacctccccagggtccgccccatatggcaccgggacaagttccatctcatccacacggtccgccgggatcgatgcctccgggaccgccacagggagggcagggtggccatatgcagatgcaaggtcccccaccacaacatggcccacagccgcctaatccccatggaccacatccgccacagcacggccctccgcacatgaatggacctccggcaccccaaggaccgggtggaccaccccctccgccacaccatatgcaaggtccccccgggggtccaggagggccacctggtcaagcgccgcagcatatgcaagggcatcctccgggtccccatccgcagatgggtcaacatggtggaccgccacaaggccagcctctaccgcatccgggaatgccaccccaccagggtccgccgatgccaccgggaatggttcccggaggttatccaccgcactcgatgccgcccaactcggtgagtaacaggaattggtagtatataagtaatctagaactttatttatagcgataatcggttagctaaattttatatcggaccaaggtaacgtacagagaggtaaattaagaggaaaatcatcgtttttcaaatttccaaagccagttttttcgcccaaaattgaagcaatgttcatgaaaatctatcattgcattaaacttacattaatttccttgacttgataaaaagtgtaaactaacaagttaccgtaagaataaataaaccaattacaaattacaaattacttaaattcaaaagcagtttttctgttcgcaactaaaaattattcgatgaaaatgtgttcattgtgtttcggttggagaatagaatacagtgaacacattttcctgtaaattttcttgattttgaaggaaaaaactgcttttgaaagttccgaaatcaatgacggatcctgcccccttaaaaacatccgaaggtaatataaagtattaaaacaggattgttacgcagggatttttagacatttttgctcgcggagcactttttggggatctgcatcttagcttctggtagaccgaattggcttaaatttggatgactgactagaaataatctgtagctttgatttgtaatttgtaattgtaatttatttatcatacgtgggcctattagtttacttttacacaaggtcaaggaaagaaaaacgtgatcaaaattacattggagaacaaatcgaataacaatcaatatgcgtaatgaactaatgaaacagttctaatcaagtgctctaagagattgcttgaatgactcgaacgatgctgttgctttgacatcggcgggtagccgattccagcacgaaatcccgtagatcaggacgctctttctccttgtttgtgtgtgcggcggtaccacgtacatcctcgaacgttccatctgacctcgttgtagacgctccaagatgtattcgggaagccgtttgtgccaagcttggtataggaagtgacatattcgccgatggtaattgtccggtaggtcgtggccaagtatcgcgttgcggacgggtacagtcgtgtcataacggttcatcttgaatacgaaacggatcgacgacttgaagcaccggtgtagttgttcctttaagaccgcgctcaggccaggatagtacacgatatcacagtatgtgaacattggcactatcactgcttgcactagcttgagacgaacaggcaaggacaataccgatccgaagcgccggaaagttcgtagggtgttgtacgccttcatggttactgagttgacatgctccttccatttcaggttggcgtccagccacagacctaaatcgacgactttggtgctaagggcaatcgtttctccgcaaaattgaattgcattattcgggacaacactaccttctttgcagaaaatgatcgccttcgttttcttcggattaggaaaaagtccattttcgtcagcccagttttcaatagacatcaggtcaccattgatagcatccactagtcgatcaacactatcgataggtccagaaacatatatctgcacatcgtcggcgtacatgtggtaatcacattttagcgctgcagccaagctgtttatgtacatgctaaacaacagcgcgcttaaacatgacccctggggtgtaccatcgacgagtcctctttccgacgacagtccatcaccgtatctaaccgcctggctcctgttcccgaggaaggatgcgatcagctgaacagcacagtcatcgaaatcgaattcgctccgaagcttatgttgcagctttgaatgcttcacgcaattgaaggccagagaaaaatctactagaaccatcacggtgcaaaagttgttatcgaggttgttgtatatatcgtgcacaaccttcaccatcgccgttgtggtactatggtgtgctctgtaggcagattggtgtttggcaagaaggtgtggttctgtcgtgtttaagaacccagtgatctgttcaagaaggatcttttccagaattttggagatcgcggggagtacacttattggcctgaaatcttttggttcgatcgcgtttgccgatttaggtagcggtgtgacgatggctttcttccaaatggtaggaaaagcgctagcatcgatgacggcgttaaacagattcaccaaaagtggcaaaatgaagggacaaagcattttaacgaaagacgcaggaatattgtcagatccagttgcattcgtactaccgtgtacgcaccaaactttgcgcagttaagaaattattatcgtatttttgcttcaaataaggctaaaatatgtatctttttattcaaacttctgccaaccataggcttttaacccttcagtagaacgcgtgatttaaaaaaataaaaatgattcacaaaaaattaaaaaaatgcaaaaggtgatgcaacaccttgtgcctaacattgcgcacaaaatctaaattgttcctaactttgcgcatgatgtgcctaactttgcgcatgccttaaattgctcgtgtactctaaataattttacttttttactggttttgtattaaataagaaggttacaactaatatgagtttcatcaagagtttttcacgtgaatttcaattcaatttattcaatcacctcaaacatagagtgcccacgaatagtaatttactctgttcttattttttataatacatatattcacaagattacaatctgagcaatatagtttacagccgcagcttatgcctatttgttatagtacgttgctttatataacttattctcttgttttttttttaattcttaaactgagagatgtatcgttgatctctcgcgattagttattttttttatctatttgccgccagtacggatattccataattgaacgcttttttctagacaattggagcttgaatcattgtccttcaactgagaagccaacctttgcgctatcaattatccaagtttacagtaatagtctcctgtgttatcacagtggattttccgagatttttcaatgcacaccttgccttcagcttcatacaaaaggtactttcaagaatattacatgtagccgctgccttatggattgagtgaccattcctggaaagatcgacagattttgtcatttgcaaggacgtacatgtatttatgtgccattccgaattgctggaagtgcgcaaaaattaagaccctcgtgtaaaaaatgggtcctaacattgcacatcgcttttttcaaataaaaattcaacgtattatatggaaaataaatggaattactagaatattacctttcttgcaaatacacagcaaatatttttttcaaaacacagttttgttcataaaaatgttgattttttgcagatccactccttagcgcttgttctaagacggtgtaaaagtacacgtttatgcgtatgacgataaggttttttgtttatttattaacattaacgagggtttcttagtaaacaaatgtatgtcaaatacttatttcacataaacgaacatgttgctgaaaatgaattgttaaaaaaatcgatgaataattatcattttttcgtgcttctttaaaatgcgcaaagtttggagctgcgcaaagttaggtgcgtacacggtaatatcaaatagtttcatagctacttccgttgggttggtgtgtctgaacttgaaacgtcctcgtgctggtcggttgatgatgctgatactgttcaccatgttccgagtaacggcctgtcttcctgtccccagttgttcatggccttcggcaaaaaactcgttcaggaggtttgcgtcgaaaacagcatcattttctgtttgctttgagctattgtggattccatctcgccttagattactccagagttttttagctggtaactccggagcaaagttcttgtttgcataacggcgtttagctgtagctacaagggtagcttgatggtcccgtgcttgaaaatcagcttggagttgaacctgatccactctccgcatgttccggaacacaaccctatgaggattgggttttctcacacggatgtcagtgatcagataaatgatttcgtggtccgaaatagagctacccgctgctgtagtagatttcacaatcgattgcggagagtctgtcactagaagatcgatggttgttgcggaggtgtcagtaatccgagtagggggtgtattcaagacagttaacccaaaaacgccgtgtagcctcttgacagctaagaggttgtatgagggttgaactgccgtgatattaacattataatcaccaacaatgtagaccctatctaggctgaactcgatgagatccagaagtagcttctcatagctttgaacgaaaagctggttgttgctggacgggttatagagcactacaactccgatgtcgtagttgttgattcgagccttaacgataagatattctaagcgttgtgcaattggaatagtaggatcgaacgatgatttcagaataggtgtggctttgatgcttttcgctacatacaagcccacaccaccacaggtctttgctccacggcctcttccaccaggcaacgagtgtcggatgaaattgtatcctggtatcttgatggggcccaccggagcggtgggtttgaatttcgtctcgctgatgccaaaaaaatggtactgcttcttgtctagagctagtttaatcccgtcaatatgtcgctcgaggtcccggacattcaggtgaccgatccgtaggttgttaccgttcgctgccattcttggtaggtttcgctgatggtagatgtcgctattgtcttgaacttgccgacccgtcagcagaaacggcgtcaaagaagatggaagattcgtccgccgtagcaatatcgtcgccgataggattcgtcaattctaccagttggtcacagctagtgatagaaatgtaccgtttctggttggacaatcgtcacagctagtgatagaaatgtaccgtttctggttgggcaatcgcacagatacggagtcgttacgcacaaaaacagacgcaataagctttctgtgttttagtttcaacgcaaggtttcggattttgaaggttggaaccgataagacttcgttcaccgtaaaccgatactctagagcaaggccggttcgaagtgaagataaagtggccctcgtgaagttctcaaaatactgtttcagaactttgtattttgcctctttagagttgaagacgacgatgatggtgggcgaaactgagcggtcggaccacttggacgctctaggagggaccctgaaacagctagcaacgggagcgtctgcttcttcaacacctagcgaaattagagcactctgaactaggatcttaacgttttccccctcgtgaaaaggaattttgttgatagtaatcctaaagtcgttaacactgcgcacacaggtgttcgcaagtcgagctcccgattcaataacttcgattttcttctcaatgctagagaccagtttgtgttgcgcagaattcctatcgtgtatctggtctaaggagagaagctgactcctcaatttatcagtactcctcctacaggtcagtcggcagccttccaactccgcctgcagttttgcaagtttctttctccgacaactcgctgatagtgctcgtaacctttgtaagatcgcaacttgatgggtttgtacaaggaggaagtgctggtatctgtttttggatgagggtatcaaggatagtacacttttcgcagaagtaccagtggttgtctatttcctggagcagtagattgctaatccgaacacaaacggtgtgaaaccattttttgcaaccgtcacaagaaatccaaccgacggtttgatctttcttcttcccgcgtttcttgacacctgattttggttcttcttgtccacaagtttcgcagatatctttcgccatagagtgatacttccacaagcaggtatcagtccaattgtctggggttatgttcgcgccgcaaaaagaggaatgcgagctttaccgaaaatcattcgcactttgaggttacgttccgaaaacttttcaaaactagtcttatgacgaaaacagagcaatttttacgaaaacttcagttactacacgcaacgcactcgttattcagtaaactggacgtactcgcatactaaaaaactcggaaacttcggtaacttaggaaaaattcgcggaggcacacaaaattgctgcgtcgcgggagcaaggttgccagaacgtagtaaatttattacatttcagtcatttttcaaagagtttcagagaattgttcaaagaaaaaaataatagtagtaatagtaatcgagagatgttataatactgttgcaagtggttgatgtgttctgcaaattcatagtcaattgattctatcacgggtttaatcaattttatggattagaaaggctagtagcaaaaattcacaaaggaagtaaatcttgctccttaagttcatttaaaatccataacatttcgtagtaaaataaaaatataattttcaaatgctaaactagatggaaaaatctacttcttacatcaagtagcacccaattttacacatttcctcagtgtacacagtacaaaacaagattctatgttaaggtgaagagtatagaaatccaatcatggctgccacaatggccgacatgtacctctatttacgatgtaaaagacatcaatctacttcgacttcgactgagactttctactagtgcacaaagccaatgtcgtctgatgctgctgtcgccagatttgtctttcagagttttggtacattataaaatttggattccaagttgttttacctaaaattaattattctaaagaaatactatgcttttaattggctgttaaagtatataatgcaataacatacaaaactcaagatattttttaaagaatcgtcagagaaaatgtaaagtgctccgcggatcacgaactgaataccactggtttgttgaaagtagaatataagtgtaaacgtttattgcttttgattaacattctcgttcacctggcgaacaatttcgagcattcgctgtgccagcttttcgctactggcggcaatgatgtccggtttgagaatatcgtactcgcctccgtcgatgttgataacgacgccaccagcttcccgaatcaggatcgctccggctgcgatgtcccacggtttgagatactcaatacagtagccatctacgttgccactggatatgtaggctagagttagagctgcagatccaaatgctctcagaccggtgcattctttgattagttcttctcctcggcctaagatgtggggtcgagctgccttgtagctggcaatggaaatttcatgtccaatcaatgcacctttgagctgaaatgttggatagtttagtttaaagtattctcatgtttgagttcattatcattagcttacattatcaacgccactgacgcgaactcgttcaccgttcaaaaaagttccctgtccggcaatcgccgtgtacatctcatccatgcacggattgtagatgattccaattttcagctctttcctcacgaccaaggctacagaaatggcaataaacttcacaccgcgcacgaaattgatcgtcccatcgatcggatcgataatccacgttggcctgtcgtccagcgcttcctttctgttagcttcactggcactctcctcgcccagcatccgatgatccgggaagcgtttcttcagtccttcaatcaacacatcctccactcgtcgatcgtactcggtgaccaaatcccagtgccggcccttgctggcaacgtccttggccgagtttcggaatccttcgagcacaatggggccgcactgtttggtcagagccagggcgagatcaaaagcttcctgaatttgctggtcattcattttcgaagcgcggcggaaaactgacactggttggtgatgatggtcacgaattgctgctactagtaatttagttgagcagcaggtatcggagatgacgtaacggtgtgtgcggctaactactgataagattatttcaggttttttgcaagcaacgatccgaagaatgtgtggaaacagaaaggggaacgttcgtattgtggagacggttgtatctcttttgttaatttatttgacattgggggaagcagtgcaggcagatacagtggcgttactcatatttactatcgttgaaacgtttgatttgaaaatgattcaagtcctttgtatagtatcagttaattttcttgtttcttaatcagcttcgtattgtgactaagtatgtgatattttttattcaaatgctcaaaatctcttaatcttttttaatgttataacaaatatggggccttccttagccgtgtggttagaatccacggctacaaagcaaagccatgctgaaggtgtctgggttcgattcccggtcggtccaggatcttttcgtaatggaaatttccttgacttccctgggcatagagtataatcgtacctgccacgcgatatgcgaatgcgaaatggcaactttggtaaagaaagctctcagctcagttaataactgtgaaagtgcttatttaacactaagctgagaagcaggctctgtcccagtgaggatgtagtgccaagaagaagaagaacacgtatcttatgaagtagaggctccctcggattgaaccataacagagccagaattttgatcttccgaaacgttcaatcagaatataagagaaagaactatcattcttggtagatggctagtttcaatcctgaaaaaaaaggcaaataaaaatcaaacaagaaataggtatctcatttagataaatatataataaattcaagctagaataaaatttacgtatccttgtatttgtcacggacaaatgtaggaggagttaagtacaacgtttccaaactactaatgaatttatttttagctatcgtaaatttgggcacaaagtttgttacaacaaatactttaaaaaattaatggaaattacacaaattctcaattcacataacgcatatttacatttgtaacgttccctctacctcttagtagggaacgtcactccttgagcttggatgacaaatcaattccgtaaacacttgtgttttattaagcttgattgcttttagttgtcagtgacacaagttctgtcttcttgctgaatttgatctatgatttcgcatcttacagggcactcatactaaatcgaccccttcgaaatcaacaatatttttgaattcaacaatgtctggggacggaaagcatctaatgcacttacacggatggctactttctggcaatttggccatgtgcttaactctttaatttcttttagatttcattgaagtgcatttgtaaggtttcatatcatttctttaggggacttttatgttatttggttatttcacataaaagaagcacatattcaacaattcacatttattgtaacaaaactaatcacatcaagttttagcctcgaaatcagcttaccacgaatgtactattgcaggtctagtaactggtctatttttagagacttggtctctatttcaatgcaaatctttgaaaagtctccattttttcacgggaggtctatcaaaaatggtcccttttttcccaattctacttgcagtgaattttgttgccatattctagaagttccagagaaacctttaaatactattacgtgaaaatttcaaaggttcttcaataatttcttctctgattccatgagaaaaagcataaagtgcctggaagtatgccagaaaaaaactttatagaaatcactattctataaagatttcttctggcatctcctccagagatccctccaggcattattttagtgatttcttcatcaagtctcatgacaaagttcttatgaggctcctaacgagtttttgtatggatttctgcagatttacaacgaattcttcctattgttctcacaaatttcttttaagattattccatttgatggaactcagctattcctttaggtatttttggtctgattttagttcccatacgagattctgggccaaatctttgatagatcacttgagagatgcaattttggatttatgtacgaaattttaggtggattaagtagtccagtgattcttccgatcattcctatgcgaatttctttagggattccgtccgataattttcaagaaattcctgcagaatattacccagagttttgatggcttacttttctttcaattctctacacaattttactacgaatcctcaagagttacttgacttagtttcatccgaggttactttaagatttctttaaataccttccggatttttaaacaattccaccaacaaaaggagtcgtcggggggtaggggtcagacatactgccgaaatttaacgtggcataatttgtgtaccataccaaatctaaaacaaaaatcttgacatttttctggagtcatcactgaaataattcctaaggtcattttttttattttttttttttttatttttttattagtatcattccaaacattacattcattattcagggtggccatcgaaccgggaaaaacgggaaaagcgggaaaaagacgggaatttgaatccaccgggaaaaagacgggaaaaaccgggaatttgagaagatcaccgggctgtaatctacaaaccaacctccaaaataagttatagaaagtagttatgtttaatgatattgtcatgaggcatccgtaattttgaacaaatatctttcaaacattaatgatttaatttctacatatttttttaaaatttttcactcttttgctagcaatgtttcaattttttttttgaattttggtctagtactgtcagggcaaatgttttttcaacttttatctaacgttttgtactcgactttttgaatcgaagtttaattacttattgcaaattggtttagcactcttctgtaattgctgaataccacaacttgagtgagctctaagtaagtgcttctatatgtgtggccttgcttcatccataccttgaacttatttgctttagagaactctttatttttataaagaaaattcaaaggattaagaattgaaataatttcaatgacggtaaagaactacttggacatcttgatgatttacttaggaacctggggcttttgtcgaccaaattatctgaaattcagcactaagatgcacttaagatgattatacaccaaagccaaaccttgaaatttcaagagaacgagtctagagaaccaagcagagctctgagctgaaattttgatcgctttataatcaccaggatgcaaccaatccatcaaattttcaaagcgaacggttttcaggttctctagatcttgaaacttgaacatgaaaattcgaagcttggtctaaatgttatatagtaggtacatgtatttattgcattcaaattaaattcaattcaatttcatgtcgtgtaggatctgtttttttagcgcaatcaacaatctctttcctatgatataaagctccagagctcgattttcgacgaacgcgagacaaatcgattcagatgaatactatactatgccatagttttcagaataacattatatatagattagaacaatctaaatcaaattactatggaaaaacaactaaaaaaatttaaactgatttaaaaaaatgttgcggtggttttcatacaaacgatttaggaaaagtcaattaaagtcgttggaaaaaatgggtcaaaaaccgggaaaattttgcaaaatataccgggaaaaccgggaaaaaagcgggaattttaaaatcgaaattgggtggccaccctatttcttatatctaggtgtactgtgttattagacaacactatcatcttaattgagtaacacaaatctgtttttattaacatttcgttaacaacatattacatttcatttgccgtagcagttcagattttttacaagtgagttgatttcacctgcttataagagaaaaaaaacgctttgaatatacttaacctaacttaacctaaacatataacgtattaatcgtggcaatagaagattgtaacgatttttgcctgaaattattgattattttatttgacatttgttccaatggatattctatgtaactcattggtactataccagggaggaagcctcagaatcattttcaaaattttattttgaattctctgcagagctttcttcctggtattacaacagctagtccatattggtacagcatacaacatggctggcctgaaaatttgtttgaatatcaaaagtttgttcttaagacaaagttttgattttctattaataaggggatagagacatttgtctacttgaaggtttcaaataaagagcttttagtttatgtgggaatattgcagaaatcttccatttctgcaagtatgaaagaaaaatatctaaacttttttgcaatcgactagatgactcgcagacttcgtcctttggcggagaggcctgtgtcatccgcaaacaaggatttttgacatcgctgaggtaactcaggtaagtcagatgtgaaaatattgtataatattggtcccaaaatgctgccttgaggaacaccagctcttacaggaagtctttcagatctggagttctgataattaacctgaagtgtacgatttgacagataactttgaattattctaacaatgtatgttggaaaattaaagttttttaattttacaatcaaaccttcatgccaaacactgtcgaatgctttttctatgtctagaagagcaagaccagtagaatagccttcagattagttggaacggatcaaatttgttacacgtaaaagttgatgagtggtcgaatgtccatggcggaatccgaactgttcattggcaaaaattgaattttcgttgatgtgggccatcattctgttcaaaatgaccttttcaaaaagattactgatggaggaaagcaaactgattggacgatagctagaagcttctgcaggatttttgtctggttttaaaattggaacaaccttagcatttttccatttgtcaggaaaatatgctaattgaaaacatttgttaaatatatcaactaaaaatgataagctactttctggaagtttcttgttgaggatgtagaaaattccatcatcgccaggagctttcatatttttgaattgtttaattctcactttttccaaatcagtctcccaggcattttcgaaaccgttctcttgattgagaatattttcgaactcctgagtaacttgattttcaattagactagtaagtcctaaattaaaattgtgcgcgctttcaaactgcatagcaagtttttgaactttttcgcaattagttagtaataatttgttttcctcttttaatgctggtattggcttctgaggtttttttcaaaattgtagataatttccaaaagggcatagaggcagggtccaattgagaaatcttattttcaaaatgtttgtttttcaattgtgcaaaacgtttcttgatttctttctgcaaatcctgccatatattttcatagcaggatcgcgagtgcgttgaaattgccttctcctcacgtttttaagacggatcaagagtttaagatcatcgtctataatcacggattcaaattttacttcacattttggaattgcaatgctccgggcttcaacaatggaatttgttaaagtttcaagagcattgtcaatatcaagtttagtttctgaagaaatgttaacatcaagattagagtcaacatacgtttcatatatattccagtcggctcgtaaataattgaaagtggagctgataggattgagaatcgcttcatgggatatttgaaatgtaacagggacaattcctgaagtaatcttaagcaattcctgagtattctaaaagatatttctaattgaaatctcaaaaaatcctaaatgacaattttgtaggaatttctagaaaacctctggagaaaatactggttgaatactgaactggaattttggtggaagtcttgagacaatcattggataaattcttgcaggactttcttaaaaattctgatagagtctttagataaattcttgatggaatatatgagatatctaaaatgacactctcggcggcataccttaggaagttcgttataaataaaaaaatgaactcatgaagtattattacactttggtcaaatatcctggagaaaataatacatgcagtaatacgagcagttatatttgtagtaatgcatgtagaattcccaaaaatatatcttaaaaatattcttagagaaatgtctgataagatttgtagagaactaaaactcttatattctaattcatgtaagattttttttttgttttcttgagtcccatttagaattttttttgcctccgtttggttttttagtttacaatgcttctttgcctaatggaaggaatttgataaaattcaacgaaaaaaaattgagattatgatatcttctgcaatactttcgaggaatcttcttggtatccctgctcactgaacttcagaaaattcataaaaagaataattaaatgtacctccgaagaattcttcagagtaatatcaatatctttagcaaactgcacaaaaatctgaattattttgtgatgaaattcctggaaaaatcataaaaatacatacagttaaacgaacgatacatgtcgttacaaatacttgtcgtgaagaaaaaacttcgaaatatcctaagataaatgtttggtcgaatcaaagacaaatcgaatgctctaagaaatcttcacaaaaacacttattttctgaatcctgtaggattatttttgatttcttagttcccgtgtggtttgaattctgtatggtctactttttaaacatgagttcctattcaagacacagtaaatattttcttcattcatacccagtacgcaaactactgatttattcgatcatatagttatgaagagttaagagaaagaattttctcacttccaagaacctaaacgaaaggagcttaagtttgtaaattcacatgcatgctgaagcggacgaatcttcaactaccaacacttacagcagggaaatacagcttgtcatcgccatcaagcggaaatccgataagctgtagttgtgtgaagcaaaaccacctactcattcggtttattcctgcaacgttcaatgtggtggaagtgactgtcggctcttctaaatgttagtcaacagcagataaaactggagataaaccttatctcaggatattgcattttttgttgtttattcaccctcgattcttttatgcagaccgaatttatccattgccaaacagttttgaacagaagtgacattatcacaaaatattgtacccaaaaagtgcagtgattttactctagtgaatcgacacagaatggtaatttcgataatttcagatacaggacgcctcctgcaattcctaaagattttttttaccattgcagactggataggggtaggaattgtataggtggatagttcgttgccggtctctgctacagccaggtggaaggaaattgtttccttttcgacatctgtttatgaacacctttggtttttgcctgttgtcatgatcacactttccgttacttctgcgcctgaagtgactgttggtttgatgaaacatttaacggcttttctttgttgttcatattagtatttgtggtgttcttagaagtgttgaagctgttctttgtttccttccgcttttgggccttttctttggcttttgcatcaaaaacacatagttccatttaataaattattcataaatgaatatttgcaaacatttctggaaaaaatattttttccataaatgtttgcaaaggttcatttgtaatatactagtaatattttagtactttcttccaagtattatgctaacaatttaacttatgtcatcctcaggagttattctaccctgagagagactcgcgaagaggaaaaatatcaacatcatatgcagcccagattccgctgtcacgaaacgtcaaatgcagcccgtcgtttttatggctgaaaaagtgaaaagtattgtattcagaataaacgggtattaaaaatctcggtcagcggagctgataagttgaaacataagactatttatttataatgccagttacgtttgaaagcatgaaatttcactcaaaatgccgtttatgcttcggtgtgatctaaacgcaatagttttctgctgagatggttatgtgagagcttgaacggcttgcacaagattgatgaaaacactgagtggaataaggaaaaaactcagcaatcgtagaaaaatagaccgtcttcgcgagtcttgtctcagattctacccattcgttaaggttttagcggctatttcaagtgggttctggtattgaagcagaacatgagagatagctttatcttatttagaacattgaacatccgttagaaaaatgttttttttttcttaaaaaaaaggtgtaaagtagaatgtggagactaacaaatatttccaagatatctgaaagctggcagtaaatctctgaattttctcaaaaccacttaacatttttcttcatacaagggttgatggcagaacactaaaagtcctgaagaccttaccatttatcgtagtgcataaacaaatacagtattggtgctcacaatccgtgaattattccaaaaaaactacttttattcaagaaaattcatcgaatcttgcaataaaagactaaaacaagaaaagtgtagaagtctatgtatttttctagcttatcaaactgcacctctaacatgttttcaaaccattcacggttcacatttattcttctcgatatcctcgatcagcttgtcaagtttatcattaatatcaggtggcgtagccggtttgcctcctggtgttttcggttggggtttcttcgctggaggtttcttatctcctggtggctttgtgccggttggcttcttcgtcgaaggattcttgcctgaaggctttacagctggctggttcttacctggtgcattcgtcccaggtagcttcttcgcttgaggattctttcctggttgctgcttcgtcggtggatttttgcctggaggcttcttacccggtggctttgtgtcagacggcttctttgcaggtggcttgttacctggttgttttttcggtgtgggttttccaggttttcctggtttaccaggatggcctccgctaggcgtagttgccgttccgttaactccaggttgtgttggttgcggtgcggttgaagaacctgaagaggttgttgagcccttggctatatcttcgttagttgtgctcagttggctcgaagaagttgttgttgttccactaactcccgccgatcctggagaaattgatgatacgccagattgaccgatggttgatgccatgctggtgactatactgtccgcaggagttgtcgattcgactggttgtcctccgtaggaagttgttgccgagccgttgacttctgtttgtccaggtagacccgcaggagttgtcgactcgccaggttggcttccactgagagttgttgcagtttcagtaactccagagtgttctgatggccctgacggagttgttgattcgccggtagaagtggttttaccgatttgaggttgtcctgtcttacctgggaaggttgtttcgccggtatgaccttcgccaggagccgaaggaacttttggtttacctttctgttttccacttggagtagttgcaggttgtccttgttctcctggaaagttcggcttgctggattggcctctgttgggagtagttccagtgccattgagttctggttctgctgagctactagaagctgttgttggatggcccgatttacttggagaagctgttgatgtacctgccttagcttcgctcggaggggttgtacttccaatactttcaggtagttctgacaaacctgaagaagttgttgacttgtggctttgacttccgttcggagtcgttctagtggctccaatttgagattgtcccgcctcacctcgaaaggtcgtttcgtcggtttgacctgcgctaggagtagttcggctttcttgttgcgcaggaacttttgatttacccatctgtgttccacttggagtagtggcaggtcgtccttgtccttttgatagggttgattcgcttggattggaagtagtagcagtgccaccgatcccagtcgatcctggttgccctgcaggggtagtcgctttgttggatttacttgtggtagatgtagttccagtccaactgactttaggtttctcaggtcctcctggaagattagaaacagtagttttagctccgctcggtgtggttgcgctggcaatgcttccaggtagttctgatgaaccagaagaagttgttgacttgccagtttggcttgcgcttggagtggttccagtgccaccaatttgtggtttccccactcttcctgttggttcgctagtatggtctccgctagaagtagtgcctctaccaggtgctgattgagccgaaggtacttttgatttacccttctgttttccactcggagttgtcggtcgtccttgtcctccaggaaagttttgcttgctagattgacctccgctgggagtagttcctgtgccattaagttctggttgtgccgagttactaggagctgttgttgaatgtcccgatttacttggagaagttgttgatgcgcctgtcttaccttcgctcggagtggttgatctgccaatacttccaggtagttctgacatacttgaagaaactgttgacttgtggctttgacttccgctcggagtcgttccagtgactccaatttcagattgtccctcctcacctggaaaggttgtttcaccggtatgaccagcgctagaagtggtacctccgccaggttgtgctgattgagccggaggaacttttggtttatccttctgttttccactcggagtggctggtcgtccttgaactccgctggaggtagttccggtcccattgagatctggctgtaccgagctactagaagctgttgttgaatgtcctgattcgcctggagaagctgtagatgcgcctgccttaggtccgctcggattggttgttgatttctggggttgacccggagtggttctagtaccaccagtttgaagttgtcctgtttcaccagggaaggtttttccaccggtatgatctgcaccaggtggggttctgctgccaggaagtgatgactgagacgagggaacttttgatttctgtgctccacttggaatagttgtagatcgtctttgccctgtcggaagagtggatttgctggattggccttcactgggagtagttgtagcttcatgtattccaagtgatctcggagtggtcccagttgcgctgactccattttgttccgatttacctggtagagttgatataccagtttgagtttcgtgcgatgtggttgagcttccaatgcttccaggtagtttcgaagattctgaaggagtttttgactcgttagtttggcttccgcttggagtggttccagtacccccaatttgtggctgtactgtcccacctggaagggttgctttgccggcatgatctgcaccaggtgtggttccgctgccaggatgcgcaattgtaggtcctccttgttctggaatgtttgacttattcggttggcctgcattggaagtagttgcagtagctttagccccaggtcgctctggttgtctaggagtgactccagtgactttgagttcaggttgttccgagctactagaagctgttgttgaaccaccactaggagtggttgcagtgccaatatgttcagatttactcggaggagttgatgctcctgattgatttttctttggagtagcctctgtgaccacggtcttatgaaggtcggaagaagttgttgacttgcctaggtgactaggagttggtcctccgcttggagtagttgcgcttgcaagtagttttgaggaatctggaccgcttgttggtttgtttgattgactttcactgggagtggtgccacttccaccaatttgtggttttcccgcttctttacctgaaatcgttgatttctcgccatgacgtacaccaggagtggttgtactaccagggtgtcctgaaggtgttgtggatttgctcttttgaataacgcttgaagtagttgcaatgccattgattccgggtgatgctgaaggttctgcaggcattttaggattgtttggcatacttgttgttccaagttgatctgcatatcttccaataggagtggttgctgtgccaatactggacgcaggatagtccgaagaagccgttgacttgccgtgattgctgggtgtagttccagggccactgatttcagtaagtctcgaaaaagttgtttcgccggtatggcctgctccaggagtgacactcctcggaggagttgattgccctggcctacccggagaaacagttgaagctcctgaatgagttttatctgtagttactgtaccacgactcgttgaatgacctgaagatattgttgacttgccgagttggccaggagtggttccagtgccgctgatttcagctatcgaactagttgattcgccagcatgtcctgtaccaggagtggttaagttgccaactattccggtgcgtcctgacggacctgtttcggtatgttgctgtccactgagagtagtgccagttattttcgattgctccgggctacttgaagaagctgtgggttgagatgtaattgctgaaccgggacgtcctgattgtccatgtcctcttggagaagctgttggtgagcttgacttatttttacttgaagttgttgcagtgccattgatacccggatgttctgatgggcctgaaaaagttgatagaccactcggagtggttccatgccgactggttccctcttgcacaggtccaggatgtgctgttttactgccttgacttgcttgtagtccactagaagtggttgttctgcttttaacgcccggttcatttgaaggttgaccatagctaggagtgacatgactcccaggatgttcaggtagacttgaaagggttgtggattcaccatgtatggttgacaatagtatatccggtggaggtgtaaccttgtacactccaggaggccaagcgggaggtcgactgggttttccgggacatgtgcagcacatgtcgttccgatctggaaagactgcaataggcgaggatccatcatccggtataaaggggtagcacgggtctccgacgtgcaaagcaactggccgtgggtaccattggctgggttgctttttcccatcaccttatgcgaacgagatttgagagcaaagtaaatgagtccgtcgtatttttttcgataacagataacttacactgcccgttccatttcaggtagccatccgcagttaggaacggtagagtgagaagcaaagctaaaaactgaacgacaaactgatcaagcatttctaagccaacagaatttgactacagtcgtccacagagtttaaatggatttttctgaaatcgaatccaattttgttttacgcaaatgtttagtaaacagcgctaatgttcgataagatttgttgttgtttcggtagttttaataattgcaataaccaacttctgttgcttctgttttctcatctttcagggtccgccaccaccggttccgatgcagccaggaggtcctccaggtccaggtccgaacatgggtggccccggaggtcccaacatgatgccgggaggaccaccgcctccacctggccaagagaacttgaacgctctccagcgagccatcgactccatggaagagaaaggactgcaagaagatccgcgatattctcaactgttggccttacgtgccacatccaagcagcagaacttgaatgcgtcccaattgcaccaattgcgcggccagattatggcctatcgattattggcacgccatcagcctatcagtaagcagctcgcgtctcagatccaggcccaacggtccgacggaacgccaccacaatgcccaacaccgccggctagtccatatccgggaggtccacaaggaggcccctctccgcaaccgggaatgcaacagcagcaaccgcctcaacctggaccaccccagggtccacagcagggccctccgggtgttccacctggtaaagtcggcccaccggagccaggaaagcctgccactggtggaatgccacccagtcaaagtcccatgccgggaatgaccatgggagggcaacaaccttctcatcagcagcaaatgggtcccggccaaccacagcgaccaagctctcaaggacctgcgggagcaggaccacgcccagcagcccaagccccagctgttcaacccattcagaagcagaaccgtgtcacaaccgtcgccaaaccggtcggtctggatcccatcatcatcctacaagaacgcgaaaacagaatggctgcccgaattgccctccggatggaagaactcagcaaccttccagccgtgatgcccgaagatctgcgaatccaggcccaaatcgagctcagagctttgcgggtcttgaacttccaacgtcagctccgatcggaaattgtccagtgcaccagaagagacaccactctcgagacggcagtcaacgtcaaagcctacaagcgtaccaaacgtcaaggattgcgtgaggcccgagctaccgagaaacttgagaagcaacaaaaactggaagccgagcgtaagcgccgtcagaagcatcaggagttcctcgctttggtcctgcagcacggcaaggacttcaaggagtaccatcgcaacaacgttgccaagttgggtcgtctgaacaaggccatcatgaactaccacgcgaacgccgaacgagagcaaaagaaagaacaggaacgcattgaaaaagagcgtatgcgtcgactcatggccgaggacgaagaaggttaccgtaaacttatcgatcagaagaaagataagcgtttggcattcctgctgtcacagaccgacgagtacattggcaacctcacggagatggtcaagcagcacaaggtcgatcaaaagaagaagaaagacgacgaggaacaacggaaacgccgcaagaagcgtatggttctggagagcggagacatccaacatctggatacggactgcgaagcgcacgattgtcgcgttacggtggttgaaacgtcgtccggaaagactatcgccggagatgatgctccgttcctgcgcgacttgtacaactggttgcaaatccatcccggatgggagtacgtcatttcggatgacgaagacgacgacgatgatgaggattcggacgagaagaaaaagaagaaggtcgaagacgatctgtcggatgagaacaagaccaaggaggtcatccagaaggccaaggtcgaagacgacgagtacaagaccgaagagcaaacttactacagcattgcgcataccgttcacgagaaggtcaccgagcaagcttccattttggtcaacggaaagctgaaagagtatcaaatcaagggtctggaatggttggtctctctatttaacaacaatctgaacggaattctagctgacgagatgggtctgggtaagaccattcaaaccatcgccctggtaacctatctgatggagaagaagaagaacaacggtccatacttgatcatcgttccgttgtccactctgtccaattgggtgttggaattcgagaaatgggctccggctgtcggagtggtggcctacaagggttccccagctggccgccgtgccgtccagaaccagatgaaggcaaccaaattcaacgttctgctgaccacgtacgaatacgtcatcaaggacaaagcagtcctggcgaagatctcctggaagtacatgatcatcgacgaaggtcatcgtatgaagaatcaccactgcaagctgacgcaagtgttgaacacgcactacatcgcaccgcaccgtctgctcctgaccggtactccgctccagaacaaacttccagaattgtgggcccttctcaacttcttgctgccgtctatctttaaatcggtctccacgttcgagcagtggttcaacgctccgtttgccaccaccggtgaaaaggtcgaactgaacgaagaagaaaccattcttatcatccgtcgtctgcacaaggtcttgcgtccgttcttgctgcgtcgtttgaagaaggaagtcgagtcgcagctgccggacaaggtcgagtacatcgtcaagtgcgacatgtccggattgcaacgggtgctgtacaagcacatgcagagcaagggtgtcctgctgacggatggctccgagaagggcaacaagggcaagggaggcgccaaggccctgatgaacacgatcgttcagttgcgaaagctgtgcaaccatccgttcatgttccaacacattgaggagaagtactgcgatcacattggaggtcatggtacagtatccggaccggatctatatcgtgcctcaggaaagtttgaactgctggatcgaatcttgcccaagttgaaggcatccgggcatcgtgtgctgctcttctgtcagatgacacagtgcatgaccatcattgaggattatctctcgtggcgtggattcggttacctccgtttggacggtaccaccaaagccgaagaacgtggcgatctgctgaagaagttcaactgtaagaattcggaatactttgtgttcctgctgtcgacccgtgccggtggtttggggctgaatttgcagacggccgacacggtcgtcatcttcgattccgattggaatccgcatcaggatttgcaggcacaggatcgtgctcatcgtatcggtcagcgaaacgaggtgcgcgtgttgcgtctcatgacggtcaactcggtggaggaacgtatcttggccgctgctaggtgagtgtatagctgttgattgaacttaaaattgagatctttcaacccaagcttgagaaaaatacatttactcaaatttgacttgtcgatccaaactacccccgttgagtagaaatatctttttctatttttgacaacattcgtagggataagagagaataccgaagaattttgggttttaagaataatcgatatacttaattttgtaataccaaactcaaacattaggcaaatagttttttttttttgcgtgatagatttatcctaatcacattctattccacaggtacaagctgaacatggacgagaaggtcatccaggccggtatgttcgatcagaagtccaccggaagtgaacggcagcagttcttgcagagcattctgcaccaggacgagatggacgaggaagaagagaacgaagttccggacgatgagatgattaatttgatgatctcgcgtaacgatgacgagttagagctcttcaagaagatggatgccgagcggaaggcagaagaggtcaaacctcgcttgattgatgaatcggaactgcccgactggttggtcaaggaggaagaagaagtcgatcgatgggattacgaggaggacaattccatcctgggccgaggatctcgtcagcgcaaggaagttgactacacggacagtctaaccgagaaggagtggttgaaggcaattgatgatggtgccgacttcgacgaagaacttgaagaagaagaacgcgagaagaagcgtaagggacgtaagcgcaagagccgccgagaagattctgacgacgaaagtgtaatttcgacagtgacgaaacgcagaaagggaaccacagctcctaaggtcaagaaacaaatgaagaaggtcattgatgctgttatcaaatacaccgatcaagacggtcgagtgctgagtgagccattcatgagacttccttcgcgaagagatctgcccgactattacgaagtcatcaagcgacccatcgacatcaagaagatcgtaactcgaatcgaagaagcgaaatacgccgattttcccgatttggaaaaggacttcttccagctctgccagaatgcacagatctacaacgaggaggcatctctcatctacgaagacagcttggagctgcagcaaattttcaccacctcgaagcagaagattctggaggcggccgatgaagaggactccgacgatgatggtaactatgattgcatcccaaatagttggcaaattgttgaaaatgcatcccacctccccattgcagacgatgacaactcggacgaggaatccggcagcgtcaagatgaagctgaagatttccaaggctggaacgtcgtcgtcctcgtcgatgtcggcgtcgaagccgaagggcacgccagggcgcaggaaacgctcccagaagaagtacaccatctcggacgatgacgacgacgatatggattaaggtttagatttaggggtttgcacaatgacacgtatttaatcaattatggattaccgtacgagaacatattatgtgtgtaggatgtaacgtttactaatcgtggaaatgcgtagctcgatggtatagaaattttccgcaattttatgaacttgattccttattgacaacaacttaaagcatgcactagaactcagttaatatatatattagatattgatcaaaaatatgaatccccttaaaattaacgaaaacggtcaacttgaaggttgatgtctgggttttccccatggtattatatgtatctagctgacaggttagcttattatgattggaaaattactagacgaaacaaggctaggaaattgaaggcgttctttgattagatccgaaaactccaatctgtgctaaggtaggaaggccagtattcctggtgttgatgataattttgaaaacatcagatggaatttagagctgaaaagcttctttttctttctgtcattacgtctcaacagggacagaacttgcttcccagcttactgttcttatgagcgctcccacagtcattaactgagatctttctttgccagttgaccatttgtgcatgtgtatatcgtgtggcaagtacgaagatactctatgccctgggaagttgagaaaatttccaacccgtaacgatgctccgaccgatggttatctgggctgaaaggctactcaatatgaatcaaacgagcgtgggtttattctacgtgtggcgtgaggtgagaatggtcggtctcgaataaggaggtgacaattctcaagtgaagtgactctccatttgatttacacggcgaggcacttcactcgagtcgagaattgtcacctccctatacaagacccagggactcgtagaataagtccagcgaataacaataagtttaagatgaaacagtttggaatcaaacatctaagactgtact

SEQ ID NO: 150 - DNA, 38834 bp, Aedes aegypti
  misc_feature (16636)..(18343): n is a, c, g, or t
  misc_feature (31020)..(31119): n is a, c, g, or t
catcgccgtacaagtttcgcgtccatgaaatgcttttcctctcgccatcgcttcggattaccgcgcgcagggtcaagcgcgtctcaaaaaaatcgccgattaattatgcaatttgctgttgtacgttcaatcgtttcctaaactcttcttcttcttctttctggcattacgtccccactaggacagagcctgcttctcagcttagtgttcttatgagcacttccacagttattaactgagagcttactgtgccaatgaccatttttgcatgcgtatatcgtgtggcaggtacgaagatactctatgccctgggaagtcgagaaaatttccaacccgaaaagatcctcgaccggtgggattcgaacccacgaccctcagcttggtcttgctgaatagctgcgcatttaccgctacggctatctgggcccctaaactcattcaccccgattcgccggcgcgatccggcgatcgtgtgtgcatccgaaatcttcagatttcattgaatgctaattttttgcgcagcaacaacagcaatcgctcagatttccgccttccggtgtttcaaattttaacttgtcttcttcttttttggtcttattcacaggtcgtgaggatctatcgccttccagcagtctcaatggctacaccgacggcagcgacgccaagaagcagaagaagggacccacgccgcggcagcaggaggaactgtgtctggtgtgcggcgatcgggcgtccggttatcactacaatgccctcacctgcgagggttgtaaaggtatgattcaggtttagaaatagtgcagagttggaatttcgctgaggtatcaaatgacgttacagactttgtaatacaaaactcgtgactaggtcgatagttacagttagcgttcgttatagatcatcgcatgctaaatcataaacatcgatagactttttattccaattttcggaaatttcgatcataattctacagaaatcgtatttgcgatgttttatcatcatagcattcagtaatgtactggaacatgtctcatgttctgctatgtcaaaaacatcgcaccaactaataacatcgcattgcaggtttcttccggcggagcgtcaccaagaatgcggtgtactgctgcaagttcgggcacgcctgcgagatggacatgtacatgcggcggaagtgccaggagtgccggctcaagaagtgcctggccgtcgggatgcggccggagtgcgtcgtgccggagaaccagtgcgccatcaagcggaaggagaagaaagcccagaaggagaaggacaaggtgcaaacgaacgccaccgtcagtacaacgaacagcacctaccggtcggagatactgccgatcctgatgaaatgtgatccaccgccgcaccaagcgatacctgtacggaacccgagtgctgtatgcgtcctcgcggaacaatcctttcgctaatccgctctttccctctcattccagctactaccggaaaagctcctgcaggagaataggctaagaaacatacctctactgacggcgaaccaaatggccgtcatttacaaactcatctggtaccaggacgggtacgagcaaccctcggaggaagatctcaaacggataatgatcgtgagtgcaaatcgggttccatcaaaccaactacgtagctccaagcgcctaaatctaaccaccttcaaccttcttttgtagggttcacccaacgaggaggaagatcaacatgacgtgcacttccggcacataacggaaatcacaatcctaacagtacaactaatcgtggagttcgccaagggactgccagcatttaccaagattccacaggaggaccagatcacgctgctgaaggtgagttcaagggatatactgcaacccttttgacgggtctaccccgtttggcataatgccgtatggcataatgccgtttggcataatagctgtttggcataatgtcatttggcataacgatcgtttggcataatcgccatttggcataatagccgtttggcataattgtgaaaacattgaatttgatcaaattcctgccattaagaaaaggggtgcgtataaactgctcacgatcgtacattccgttgtcagttagtgataggacagaagtatgtcatcatttttcaaggaaaccaatatccaataaagctcttttggaattgcatcatacatgacttccggggtcattaagtgcaggatattatggcgcagctttaacaaaaatatatccaacgcctaagttattcgatgtcatttgaaaaaataaagaaacatggaattttatgaagcttcttatggtacggcatatcgctgtaccactgcagtatcttcctttttcaaattatgccaaacgaccattatgccaaacgactgttatgccaaacgactattatgccaaacgactttatgccaaacgactgtatgccaaacggcataatgccaaatggcattatgccaaacggggtagacccccttttgaccgtcatttccacttgctagaagtacatatcgtgtccttgatttatacaaaatagcaaataccagttatgagaaatctagatgaaactgaagtctcttgtgtccaaaatagtgaggaacctggaaggcccaatgatctaaaagtcctctgctttaacagtcatacaactccctcttcaaaaacaaataagggaatgataacaccgttgatttttgttgaacttctgataatttaagatcttcgttgttttttggacttcactacttttttttactttttcttgctgttcagacttcatatttattggctaccttttttccttttttttcacacactgattcgataatataagaaagcagaatcctcgtcaaaagtatagccggtttaccttggaaaatttggtccttcttgccttctgatcatttacaccttcaggagccaaacatctgagcgatttacttcactcaggtctttcttccttctgatttttctttctatctatcatttatgctctttagcctttcctatttttcagatctctcttccatcttttggttcttctttctcatttttgtgtttctaccttcagcctcactacttctccatgaacccttggtagtaacgcgctagtggtggatacgcatcttgttttctcccgtagtcgatgcttgaaaagtagtcgtttgcggcttctcgttgcgttccgagttactcttggcaaggtcaatatgcacatccacggtgtcttcgggagttctcccgtgtatcctttatactccgaagctttttccgatcttctccacaatttgaggtccctgtcgttcagttgtatacaatctgattagttgccttctacttctctgcaacagtgctcgtctgtcagattccctctattcctcttgtctttttttttttcgattgcttgtcgtccttttcttttgatttataagactgatctattgtttcagcattacggttttgcaccattttgtcattcctactgtacttctctactttccagtttcttaatgatcttggcaacccttcctgttttctcccctcatctttctgcccttattgctgtgtgtctttgctgtcgttaggcattgtggttttctgcctggtctttctcatcttttaatctttttgttttctgttcgttttgaatttatgctttgctggtaattttgtccgtaggtcctatcttctttattgtctgctccttctcgagtgtttttccttctaatttttctgcattccttttcccttctaaatttaaaggtcccacgattttgatcaaatatttctctacgaaaaaagcgtgcttacttcctttttatgttttacattttggtgtttctcgtcttttttgtcttttgatttttgactgatctgttgttttaaccatgatgtgctttacttcataagtatagagtatttttgcctccagaacttttcttacattgaatcatctgggtattatggtctgtcatctgatctttcttatctctgccttctgctcgatcccactatcttgtcttgtcttagtgtttgtcctgccttatgattttgctatcaaatttgtgtgatgtgaagccagattcatttcggaagatcctagaccagggctactcaacttacgacctacggaccacacccgacctgcaatttcccttgctgcggcccacgatgacctcagtatttgttagaattgaatttcaattgagcttgcacaaagttgttgaattggttcaaaataccgtaaagtgccgtaattcagcgcagttaaggaataaaacgattcaaatggttaactaaaaaaagtattgcatcaataaaaaagctttatgagtggatcgctagcaaatccattttagattatgggaaaaatataaactagactgtattcataatttaaaattgagatttttttgaaatagttcacttgtagaaattgcctaattccgcgcacttttgaaacgcttttccatattccgcgcagaagaacgcctaattccgcgcactcgcgaagcaatcaaattaacattaatttcaatgtaaggcagaattcattcattacgtaacgctgaaataggaaatttacaaccccctccaccctccataatactttttgtatgacaaaaagtaaatttttgtatgagccgtttagttttatttcttatatttttatgactatcacatgaaacaaagataaacatttgttatggtcttttcattaacgtggcattgatacttgtgaatttcgtataggggaatgtgtggcagtttggagaccttaacgaaattcgatagaagtgcagaaaacattatcgaattatcagttctttgtactattttcaacaatttttagatccgcactatttccgttgtcctataaagttcacgaatgaatgaatgatttttcaaaatttgtaatttttcgtgtcgattttttattgatgggatgatatgagcaccctattttagattgtgaaattatctcatagaatcatgtaattaaactttagccgctatacaattgaaatcgacaaatagaatcatactgtggacattttttgtgtatttactcaaattaccttactttttgaactcgtcagcggactactggaacatgagcagatactggtaaataagttgatggtatttcgagtataatttatttagaaaactgacttataacatacatattgcttaatttgcttgccagctttggagttgcattttacttcagttgaaatttcaaaaatttatgcagttttcaagaagtgctcattccaatccattggcgaaaccgcccctactacccctatagttatttgtattctgcattgttcatacaacacaaaaaccagttcgcattattgcttggaatcgatatgtcttaaaaaaatcaatcaattgtatccgctaatgccacgaatacctgaaacttaaatctgttaagcaaactagaaacctcagaagatccataaagtttatccataaattacgtctcacaaaatatggccatttgcaatctctcttccccgtatatcatactttttgttatttgtggttcacaatgttaagtaaattttgtgtgcacagatgtatagattctctcctcttgtggtatattgttcagacaacaattttaaaatttttatgggctttggtctttggataaactttttctcttaacatgaatgaccacgtggtttctgggcggtcgcttttagtttccctgtaagtgagctttcccgagattctgcttgcccgtgaaacgtatttatgcatgaagacacttttcattgaaatagttagatgtgaagacgaatatagcatgtttaccttgtttattgttcagcgaagaatagtgcgcggaattagggcattataaaaaaaaacgtgacctaaacccgcgcattactttttgggatgagactcaatgctaatatttgataagatttcatagaagcaccatgaaacatatctgtagcaagtagttccatagaaaattgcataaaaaaataaaacattttcaataaaaaaatcgcttttgtttttgtcctacagtcttagcacggacgctaaggaaattagaaaaatggcgtcaacttcgacgggcctccactgattatttttttaaaatgccttatttgcttttattgatgattcgaacttattctaaatagtagtagcatcaaatagcattgaaagttgttgcaatattgatgtgtatttccatatataaatcgttttgtatgaaatgcgcggaattaggaaatgcgctgaattagggcactttacggtacatgaattgatcgatcaataggtctgcccttgtgcatctggcgtcatgtattctgctttctggtaattttgccttcttgttttactcttattaggtatatttgccttctatttatgtctttgccctttagttcttttccactttctagttttttcatttgttactcagatcgattggttttgtctcgcactattctggactttctgccttctacgggccactgttcattctgagttctgtttgatccttcgacattgacgtttgctcctgcggggcggacgacgagggcaggatcaaacatgtcgcacatcgtccgagtaatggaatgaaaatgcgccgcggatcgttagtagtgtttgatctattgatcgcgtcacttgctcttgcgtgggcgagtgatgaacacttgttcagcgtacaacgcgattatcgaactatatcgtgaatccgattaggcgtgattacatcatggatcgcatcaccaattactggtgactcccacatcttgaccttatcccactaacccaatatcctttccatgataactgtggagatgcagaggtatactcgatctctagtaacaacggtagtctaactaacattccttttcttccccgatgaccgtaaggacgtggccggtgcagttattgacttttaaaatttgagctctcaatttgtgcacattggagaatgagtaagctagttccaagccccattcaataaatctctgtgcaactttgattgttctggtcaatcacggagtagcaactacgaattgtacggtcatctatgctcatgctcatgctctacgggtcattgttcattctgacctattccaccttctagtttaaaaattatctatcgttcacgattcttttggtctagttatcttcgaacgttctggtatcttaccactcttccttccttgccttcataatttatctcttattcggtcttttgtcacatttaggccttcttactgtccagctataaaactttttagatttcgtttgtagtcggtttttggacatttcctcattgattttttaatccctgcttgctttagcttttgtctatcatatttttttctgctatctgagttttatgtctgatctggtgtttcagcatgatggtcttacttagaatattgaattattctaccttctttctgaagatgtctaacttgcagtctcttatggcttttggcttgtgttattatctatttattctgaattcttacttctgatctctcattttcctcttcttcctgcctgctggtgttgcattcatttatggctgtgggccgtttgtctcgtactgcttgccttctggtacttctaccttagggtacttgttcctactgatattttctaccttctagcttaactgttatctatcatttgttctgtttttatttttttttattttcacattttggccttcataaggacgaactaaacttggaaaattcaaggtcttgtatgtatatcttgtggtatttctgtcttctggtctttattgcttctgtctgctttgatctccagcaaagtttttgatgttgttctagtaacatttgctgtcagctagctttcatacttacaagctttttctgttatttaacaccttggtttatctcttgtacagttttcgtgcattccaggtttttctacaatcttgtattttactgaacatttgaactcttgatcgttttgccttaccatcttctcatttcctgatttttatttcccatcttcattatgttttctattttcccgtctttcttgccttctgagttttttgactgatttggttgaaagttaagtctttctacttcctaaactcctcttactttcatctgggctttatgtgttttggtttactttgttgtctgatctttctgatctatgccttctggtcattcccacctattgattctcgttttactttttttttggcttttcattttgctgtcttttctgctgatgtcctatgccttctaatttcaatctaatgaaccattgtaaatgaagtgtaacttcttagcttttccaacttgatcttccttgtgtttcttattttagttatagtatttctgtcttctttcgaaattgtgtacaggttcgcataagctttttctttttgtttttttatatgactgatcagatcatggtcacgtttttaaaacattcagcactctggcttctgaaactccagtctcttgtactctctggtctttatatcaattacttactattagttctgtcgtaagaacttcatgctttttgtctttgctggaattgagtgtttccgcgtaaaggtgtttgtatttacaattttttctgtttactggttttgttgacaactttagccgtatatataatcatcttggatgattctgaactttttgttttctggtccttggactttggatttcttgctccttctatttgtttggcttctagcttaaatgtattctatcacttatgcttctcagcttttcctttgtttggtattttcttccatctgttgtttctatctgctttttgtctgtcaggaggcaaaaaacaaaaggctgagataccaaaggcatggagcttaatgctcttttatgtttcagcattttgttttccgcctcctgacgtttctgttaactagataccagttttcaaagttgtgtatggatttgcatttatgattttcgatttctgaaacgtactactgattctcattttgctcctatttttttgtctttcgattttgcgtcaattttgggtgatgcaaaggcattttcatctcggaagatttcagacgctttgccttcgggtctttataccttcgcatctttgtttcttctgatgttttataccttcttactttaatgcaatcaaccatcacacttcttagctttttcaactagttctagtttttttctgagttctttctggtatccttaaggcttttttgctttctgatatttctgtcttctggtctttagacatactgatgtttctgttttccaccatagttttcgaagttctgtaaaggttcgctaaagcctttatttttttggttggtctaaatgattaatcagatcacttccttatctcaaaatatggagctttctgccttctgaatcttttgggtttcttgtactctctggagtatatcctaattacttcttacctggtttgtcgcctaatcttcctggtgtctttttatactgccattagatctttcggccgaaaggcttttcccactttctttctatttacaattctttctgccttctggttttgttgtcaacttcgatcgtaacgccgaatcatctaggaaaattctgattttttcaccttctggtccttaaactttcgagcttccgttcctactgatattttctgtgttctagcttaaaggttgtctatcagttatgcttctttgcttttctttcatctgttgtttctgctatcgatatcgatttccatcaactgtttcgtactgtttaaaaatggtgtgaatgccggcccaaacagagtcactatttgctcatggaatggtgcttcatgggtttcgaatagacgatttctgtcgcaagtgtgtttttttccttattgatacagcgccagattgaccatggtatttccaagaatatgaatgttgagttaacacaaatgacagactgttttcaatgtaaagcgtcgtttcagtacaaaattattcatggtaaaattttactgaattgacgttcccaaaacatgtcgatcggttgataaatgtcaaagttattcaaagtttatataccaacatgaaagttggcgctgttctaccatctagctttcatacttttgtctttttctcgactcttttttgttgggttttagggtaaattggtataatgcgccccaaccgggcaatacgccccacttcattttctagggattaaggcttatttgacacgtaaatatgattacacaccgtgaatatccgcgaaaaactgatgttgcacatataagatctttgtgaagtatgaacaatcaacagaaataccaaaaatatcgaaaatcagctttttggcgtaaaattttgggtccgatagggaagcctcgttgtaaatgaagcccatcctttactattgtacttattacaaaaacttttaccggaagaagactgctaatagacccttttaagcttagcaagtggtggaattctccttgaaaacatttctacagcgctgcggaactttttctacgggaggggcatattgcccggtttgttttgaaacgtcaagatttggaccgtttacagaaaacgtcttgtactctttttagaagttacctggcactaagtaaacaacactttgacaccaataacaatagaagtaatccattttccactgaaatagagcaattttccgttaggggggggggcgtattatacctgtttaccctaatgtcttctagattattttactgttggtctcttttgatttatatacttatctactttctgatctgtttgccttctcagctaccgggcctgtctgttttgtgatctatatttttgcgaaggtcgaacttttgcctcacattactctatttgtcatgtatgtttcctagcatttcctactttttgctttttttgtcttccgttttttcttctgttttgttgttttaggtttttatattttgacctttctattcactgatatttttgccttttggtatatcctccttctaatatgtctgccattcgaaatattttttggattttttttacagatataccttttgtactatccactttctgacttttttttattttcctatgtagtaatcttctggttttctgccatggtttcctactttattttttgttttttttttttcattttggattttgttttctaaagttttctacttcttctaccttctggacctttttatattacgttttttttaactttcaaacttttttttttctatctttattaatgagattagattagccctagtctagttcatctcggaaccaacggctctacatccctttcgaaggaagtcgtcactagaactttgacgtcacaagtggctatctcgaggatgggattcaatcccaggtcctcggtgtgagaagagtgtgttctaaccactacaccaggcctgcccccttttcaaatcttgtttactttcaagcctttaagtcactggtctccaacctttctgatgctacggtccccatagaagtttaacaaatattctgtggacccctaagaatggatatccttggcagacacataaaagtttcgtccatcccgtccagccatggaagttcataaaaaatcgagtgtgctgacaaaatcttctaaggattaagctaaaatatcataataatttcccaatgttaccgctattaaccatgttaattttgttttcaagtttgctgaaaaaacactcatatttggtgagataaaattagcaagtaatcttcaattgacagtatagcatgtactttattagtaattgtgtagataaaagagtaatttgataaaatatttgaaatattgaccatttgtaacccactaacaaaatgatctctttgccaaacaaacgaggtgaacgattcttcacatttattcatcccttttttacaattgcttcgcggaacctctgagtagtcgtcacggccccataggggtccgcagaccatcgattgggaaaccctgcttatgtcattttgttcttatgatatttggcttattttacaaccttctatgatattcatgatcagatgcatcattatcaggactatgcatttttttttgcttgtgaactactccaacttcataactgctcttgtgacatctggcagtctgatttgttctgtcgtccgattattatgctttctagtcattttgttctcttgttttcttttttattagatttgttttgccttctatgtctttgccctttgttttttcacaccttctagtaaatttattatctattctttctggtcttcttgcctattggtctttacatgtacgggttattattttctgctctattccacattctagcttaaaaatatccatcactcatcattctaggcttttccgacttttttttgcttctctttcttatatattcttgctatgttcttgctcataatcagaagacagctggattctagtctagtggtcttaagatgttctgccttccagccttcaaaatttcatgctttattttacccatttcggcctctctaccgtccagtatcatgctttctggatttgtctatttttttctttctggaggtttcgactttttggcctttttttctactgatttactctgctttcgtaaggtttgatgttatgttttctggttttcattattgatctgatgtttgagcatcgtggcatcgttttgaaaagttgagattctgccttctggacttttttgacttccagtattttatgtcaattgccatatgccttctggcgtgttctatcgacggaaccttctgcttaatgttcttgttaccttctgttttttatgtctttcggtcttttttgtctgctaggcttttgcctcctcgttcttcctaccttctagtctctctatttgctcgtctttctacatttagattttgctgtcagttttcaagaattgtaattatgggagcctgcattagctatgtcacgattttagggatcgaaattcagtcatatttgttgattcatgctaaatgtactgaaaattgatgcatttgaatgtgaattgaatccatcagaaccatagaattcaaccttgaatgtttcaattttatgatgcaaggttagcgaaaagtattagtcctgaaccctttttttctttctccacttttcggcagaccaaataccgtacagtcgtttgacctatgaaccattgcgctaaacttccaatatccaacatcccatttctaatcacaattcaatttctttcttctccccaggcctgctcaagcgaggttatgatgttgcgaatggcccgccgctacgacgctgccaccgattcgatcctgttcgcgaacaaccggtcctacacgagggactcctaccggatggccggcatggcggacacgatagaggacctgctgcacttctgccggcagatgttctccctcacggtagacaacgtcgagtacgcactcctcacggcgatagtcatcttctcggatcggcccggactggagcaagccgaactggtcgagcacatccagagctactacatcgacacgctgcggatctacatcctgaataggcacgcgggcgatccgaagtgcagtgtgatattcgccaaactgctgtcgatcctgacggagctccgaacgctgggcaaccagaactcggagatgtgcttctcgctcaagctgaagaaccgcaaactgccacggttcctggaggagatctgggacgtccaggacataccgccctcgatgcaggcccagatgcacagccatggcacccagtcctcgtcctcatcgtcctccagtagtagtagtagtagtaacggtagtagtaacggtaacagtagtagtaatagtaatagttcacagcacgggccacatccgcatccgcacgggcagcaattaacgccaaatcagcagcagcatcagcagcagcacagtcagttacagcaagttcacgccaacggcagcggaagtggtggcggcagtaacaataatagcagtagtgggggcgtagtcccgggcctcggcatgctcgaccaggtatagctagtgtagggcacggtttccgggccggtttccattccactgctggccagcgaaaccatgcttccgccaccgtcgtcggtgtcgcctttccccggagcggacgacattctgttcattgtcgatggctagataaagagggggaaagagagagagatatagagacgcactcgccgcacgtggcgcttacagattctacagattttctctatacctataattgtaaaaaggctttaatttatttcttctttttcgttttggactttgtttttgtatattcttgcggttttccttacgcgcgcgagcatgccgctcgtagggaccttgggcagtgctggacactgctggtggaatattgacttaagtaacaatacctagataggagatacgaggggggcgcagattagaaggcgagacggaacgacacaagagggaaattcaacattctgacagcatcgtccagtggcacggttcaacgtagcaagtgactgaattacaatttttcatttttttttttgtttgaaacttacatttagtagggctattacgtttaggttttgactttttcgcaaaacaataaaaagtattccagtagaacgcaaacacggtacatacgcgacgagaaaggttggggcggaaccgtcggttcgaaagttttttgtttggtctgaacgcaacacaaagagagaaagttccgctgcgcaggctttactgtgtaatattaggaagttaggaaagagtcgtgtttatactaaatatgaccatttatagcaggaaatcggggggaaactgcgacccgcgacataactcatcctcactcggaaatggtttggttggaagtagatgtgtttcggacgagttgtggactctaactcctattttagaaaatagaataaaaattacgatagaacgagctcaccattacttgattgtagtggttatctttgtgtcgagtcattgtaatgatagtggaagtcgaaacattctccatggcttacggctcctgctgttgaacaggactttggctgtcgagatgtgcttcgggcacgtcaatgcaactgtcaaacacaaagagtatcgtttcacttgcacacatatacttctatccagacatttccgtatgcatctactaccactaccccctctgtaacaaaactgaagaaaacccaatccccatcctcccctctcaaaacccataaacacacacactcgtacaaccgtaagtttacgcaaataaacacacgttttagctggtaaggaaaacgaaaagagatggaagaggttccccagtttttggtggtcggcgagaagaaaacaacccggtgagacataaaaatcaaacagtagtaggaaacaagatgctgccacctgcgaatccgatcgtcggattccgaacacacacacacagacacccatatgatactagccaccccttcccgaaagaatcacacacactcactcattcacacgaaacaatggaactactgctagttactaccactaccacgacaaccactgctgtgggaatccacgtggatccccctcccccgcggagctccgtgcgggagaggccacgtggtcgtcccttcggtggcgacctcttccggtatcgtttggctgtgacttgttaatatttttaagatgatgatcaatatgataacagaaagaaataatgtagattatgatgatgatgataatacacacacacaaacacactatagtatagtttatgatgatgtatagtttttagggaagtttcagtgcgaatcagtgtggagtgccgcaaggcaagaaagcgagcaacaaggatacgttgtagttgtactaaactaactccagagagtgaggttaggagcggcgagtgattttataaatgagcgaaatgcgagcgagttgtgtatcatactagttggtagggtaggataggcgagtgagaatcttggcgtgcgaagatatgatgaagcggatcaaaatatgaagtagttggaagagaaaagaagctctattatatatgtacagtagcgtggtaaggagtacggcacgaaggagcaacacagtttaagatgtacattttttcctttacttttgagtagggtttaaaagagtggagaagtactattattgaggatggagaggatgatgttgatgagtgagatggatgagaacgcaatcggtacggcgcaggttagaggagcagggcagagtgtgggcgatcgggattgggaaaaggaggatcaaaagcattgtttggagatgatcatggaacaattcaaaaggaatatcttaggggctaacttctctatgattttttttttttcaatatttatcaattcttgaattgaacagattccaccttagggaagtcaaagatgaaattccacatcagacgaagaatatatcaagattatttttcaatttcagtctattctacgactggcgtgaggtgacaattgtcggtcttgtatagcgaggagacaactcttgactcgaatgaagtgaccaatcgtgtaaattaattcgcgcctcatattcgtctagtcgttcgttgtattcttgtagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagatatccaagatgccacatacacaacataagaggatatctacaatcttttaatacagaggcagagagaagccgaacccccaatgggaaaatgggcctcctctcacacacaaacacacaccagacaattcgtctaaatttttaatgaaatcttgtttttatttaattatccaaatgagcatgttactgtaactactttgacaatttttcccgctcaaataatggctatgtcatgtttaaacattaatttaaaaatttggtccataatgaaccttgacacttttgatcatgtttgacgttcgcttagtcgacaaaacaccacaggggttttagttcgaccactggggttgttcctatctgacatttcgtaagggacacggaaaacaaaatacacccaaaatttgagtttaagccaaaggatgtgacaaaatctaaaaaaatgttttttgggcttaaaccaacggaaaacattagaaaattgagtaaacatgtgtttatggcctaaacttaagcgttttgcactaaaaatgggacagggctttaggaccctattgtcacctcatgccactcgtggaattaacctaacttattaagttctaactagtgtgaagaatgattgataatatttatagtgaaaatcttaggaaactaactgtaagaatcgttactagaaacttttttaaccgttagaaaataattggagcaattctctatggcatttctgaatgaatcaatggacggtttctcaaaaatatctacgatcaaccctgtatgatctgaacgattttttttggagaatagttgaagtaataaatggtgtctttatagacacttggactctatggacaccaaattcaaaatatctcgtcaatcatgttattcacgagtgatatcactgatggtatgctgcaaatattaatactaacaagtaattagcagtagaaacgctgatatttccggtatgcttttcatcattagcagtgcaagcactagaatacaatagaataaaatagaatgctcagaagagtttccatagacaaaatccacaaaggtttatttcagtgtttttgaaaaaatagcttaaggtttttcttgagaagcccagcatgaattcctccttagttcaacattcacgtttccttccaggtgttcaaaattccttgaggggttcttcgaacaaatctggcaatttctctagtattttatctaagtattactgtgcagttgttccaactatttcctaaaacgtttctcaagtaattctcatgcgatcttcaaaagtatatttagggttttaccccagttaatacgacagcaatttttccaataattcctccgatcactcctgcacaaatttattcagagattctggagaagctaatgattgaattttggaagatttttttacctggaatcttgaaggattttccagagaaatcgatgaatgaatctttggataaaatcttgaagggattaggattttcttgaaaaaaatctccaagatattttggataaattcagatgatatctcgaataacctttttgagaaatttcatttatgtggtaattaatgtagaaattccttcaaatccagaaaataataactaaatatgctattttagaaattttcggagttctacctaaacacacctgaaatcgtttctgataaaattcctgaagaagatcgtgagaacacatacagtaatacgagtagtaataattgtcgtattgtcacgaggaattcttaaaaaaatatgttagattttagataaatacctgctctggtggtattaagaatcaaactcttatccccaggttcctattaggttccgtttagttttcttggttcttgtttggtatcttttcggcctcgttttgtttttttttatgtctctttttggtttattttttcaggcgatagagacttatttcctattgttaaagtactcagtggttaccagttccgtaaagacgaaacactttcctagtctacttgtaacaactgacaccctttgcgtttgagcccctagaaaatagtaattttcaatttccagtctaggattccatagtgttaaaatattacttagcttcactgtgcacaaaatatttgccaacgtttgtcctactcatggttctaaacgtgaacgcgcctctgttaatattattttggatgtttgaattaaacagaaccctgttctgattgcatttcggatgataagtaaccatcaagatcgctaaacgatcactggttaggcttgcaaatcagacgacctctactcaaagcagatcttggagaatcttgagcgagactgttgagcgcaaaacttggcagaacatgttctcacgagcagtgttgacatactcacactcaaatctcaatcaatgagctcttccgtgagagcaaattcattagagatctgcttgagttttctcgtgcaagatcatgcttgagttttctcgtgcaaaatcactcagtcgcagtcatgtcgtcaaaaatgagtcataaagctcgtcaaaaactcgtgagaactgaatgctgttgtttgctttagaaagaatcattataattctgccagagtaccaagagatcattgctttgcgtgagtaaactgtcgaaatacgagacaatgagtcaaacagattagccaactcatccgtgatttttttggctgctgagttgcgtgattgacatctcacaaatgaaaaatttcattcgtgagttatgaaagtttgagtttatcacagaactgctcatgaatccatatgagtagatattctgttcataaaccattgagagatcactggttgtgctttttgaactaaagttctgcacggtagggcatatttgatggagcatgtttaggtataaaccatattgattaacgtcagataggtaactggttatgcttgtagagctgaaggcctgtactcaaattagttcttggataactttagttggacgttgaactcaaaacataatatatcacagttgtttgatccagtgaggagagcatgaccctttttcattaaccttcgagagactgctggttacggttgaagatctgaaggtctttattcaaaggacttcaatgataacctggaaacgtcgatggaagtaaaacttagtgtaacaaaattgtatgagcctgcgtgagtgtaaaccattttcttaatcttcaaatgattactggatacgcttgttgaactgaaatcctgtactcaatgagctcttcgataatcctagacatgatacatcatgtttgtttgagtttgcttaagcttgctcgggtatgaatctcattcacaattctccgagatatcattggttacgcctgttgattcgaaggactgtcctcaaaggagttttcaatacccataaacaattgttgaactcgaatcttgataggacatatatttgatagagcatgtttgggtgtaagccttattgatcaacaccagataggtcactaagtacgcatctagatccgaagccctgtattcaaatgagttcttggctagctttagatagactatgaacttagaaggttatagaacacagttgtttgagcatgaatcatacctgcgagagattgcttattacgtttgtaggtcagaactaggatctgaaggtcttggtctttactcagacgagttcaatgataatctcaagtgtaaatcataacttaatgtagcataattgtatgagcctacgggaatgtaaaccttattcatatacctttatatgatcactggttatgcttgtttaactgaagtcctgtattcaacggagttctaggataatcgtagatagctgttgggctcgaagattcataggttaggtttgaagtctgcttgagtaaaaatagcattcatacttcgagagatcactggttacggctgttgattcggaggtcttgactcaaaggagtctttggcccaattaaaataatctttggacagtttgcaatagaaattcgatgccaaacatcaaacacctccatatttgttggatctagcaggcaatagtggttatcacgcccaatggtatgggtgccttagtgtagatgtggttgtgaaccttagagaaaacaatatgctctctgtctcgaaaaacacccagaatccgggtgtaaatttttcaaattgggtaatatttccatatgtgttttgatgagtctggaaagcgtgtgcaagtttctttgaggaaaacaaaaccaaactatgtatgacgagcgtatgctagttttcgtgcgttcaaatgtcactaagctctatccagctttttaaaagcgtcaatagctgccgcaaacggcctcactttctggtagggataagtcgattcaatgtttggcttgggtcgttttatataggcctattcaaatgacgtctcaaatcagctgatcgggaagcactttgacatttcttctatgaaaatgacaggcccgtgttagcaccggtccttcaccgatgtaaacaaatgcatagacggatctgtcacatgaaaaggactattgaacggacccaagccaaacgtcatatcgactgatccctaccagaaagcgagcctatttgcggcagccattagcgctcgtaaaaagctggatagggactacaaaagtgtttaaattttttcatgtttccgaatatctcatttagagattatatggcataatgctcatttggcacaacagtgtttcataaaaaaatctttgaaataaggaacttaattcttatttatactaaatggccaaccaaatgaccttaggccaaaaagctttattgcctaatggaccgctcccttctgtatcaataatatggatccgttttccacaatcaattaagaaaagtctgcaattcatcccccgaactatactctcgatcctaccagagagtaccattcacatctcttttcagaaaagtgatcgtacatttaccagtaactaccgaaaccgatcgccccctaaaaccccctcactctgccctcgtatggggggctcaattttacacgaatctaacccctagaaagcgcaaaagcagcgagcgaatgaatttggacagcggatgtgtgtgcagcacctgcgcacccattcgtgcaggcgaaagcaatatcttagttttctgttagaagttagagcaacaaacggaaatcggtcggaaccaatagcggcgaaagcacgacacgcgtggaatgaatgaacaaaccgaaaagcgaaccaccaaactgccacacaaataaaatcacaacttgaacaaacacaatcaaagagcgaaatgagagagatgagggaaaaggaatgtcgcacagaacagagattccgatagagactgagatgtgagcagtcagaacgctgttgcggcagctcgcaaagaaaccgagtcagaatctgtgtgtttttttttttaggaaaatttcgtttttcgctacccaaagttctgaactttcagtttttgaattcggattcgaacgaatttagctacatgcacgtatcaaaaaaagaaaatccttagtagaaatttttagtcaatcatttgattttcctcaaggaaatccaaaagtttcgttttcaaactcaatggaagcaggtgaaatgcaaagcaaaaaatagtcaattaaattgtagggaatttgtttcgcttcgtcgccctctggaaaaaacttagcaaattatttgaaccgtagatgtgaagcgacattttttttcttttgaagccaatctaaacggggatcagttgcgaagcacgtaggtttttttgtgccgcttataaataaatcacaagaaggagagagaatagaagaatcggtttttgatgatcaaacacacacgcatacaaaaaaaacgagtatatttcggaaacggaggtgccttcagaaaagagatgaaaaacgagagaaagaaagaaaacaaaagatgataaaacaaaatgtaaaagaaaatctaaatgaagaaaagataaaacgagcaaagtgcagttgttagcgagcggtttgcgaaataaaagtaagatagatgcacaacaaaaacacgacacctggaaccagtttgaaccctagccctagcgaaagcgagaagatagcaaacgaaaattgatagacttgtactgtgtaagccgttgaaaccaattcgagatgagtaatttgagaggaaataggaaaaacaaacacaaacacacacagatcgcagattttgtgagacagataaaggataaaagcgacagataagagagctgatagacagacgataggacgtcgtttttggggggagaaggaaagcgttcgagcgaaagcgaccgattggttggcggagaggaaagcgttgtagaaagaactgggatatgtgcaagaataagaaatttctcaaatactattaatatttgtattagttactattattattgctatattattttattttattttttgtaataaaatattttttaacaatttccgagatgtgttttagttcggctcaaaaattgcttccgttttgagttcttcttcccttctgctagtttgcctagtttgatgtattattgcgttaggcatgagtatttggtatacagtcaactttcgttcgttgcactaaaccggtagcccacctagtgaaagactttcactaatcgggccaagttttcagctgtcaaaatatcgaatacaatagaaaatcagggctaccaacattgataaaacgtgatttatatcaaaaagtaacgtttgtcttcattttaagtgggctatagcccacctaacgggagcccaattaaaacgaagcccacctaaagatagtgcaacgaacgaaattcggctgtattctgatttagtcataatattctgagctgttgatttcgacgagaatttgaaatgagtatttttactgtgctaacataactcgaagtcggtggagtgcaactcttatttattgtacgtaaacttgcgtacaagcttttgcatgcaattcatttggaaggaactaactctaaaacaattctactcacagaatgtgttgacgtcacaaaaaacaagctccgcttaaatttatccattctgaaaatctgataaaaatttctactagggcaaatgtaccattagtggtgcacctaagcgaaaactgctaaaacatggtgataaaataaaaaattatatgattttagcgtatcaatcgctagatctcaaatccttctatcattcaaatgtataaaaatcacgattcatttgaaatttccctgcaaaaagccttgcaccaacaataggaacactgttcctttagtggaggtatgttttaagaatggttcctttagtggcgcaaaccattgatttcttatgggaccctccactatgggtactgatgcaccactataggtgcaaaggagcaaaaaatttaagcaaaataattgtttaaaataggtttatggttaaatttcatgaatatttttcgatatcttgtatcattttcacatcgtacatcatagaaaaatatcacatagccataaaaaagtgcgaaacatgtcaaaacacactacctccactattggagctacctccactaagggagcgtttgccctaacttccatgaaaaaattcttagttttttgaattgtttttcactgtaattgagttgggataactcattgctgtccagaaggattttttaataaataagtagaacctgagaagtagaactaagcgatactccaagtcgaaattttttacatctgattggtggtctgtggtgaagtacttacaattgcataaccaacggcgatttctgaaccatttggtttagagttagttatgtattatgagcactttgtcgaaatttagcgtcacataatttgtgcaccatcccttgccaaagttgccatttttgcattcgtacaacgtgtggcaagtacgatgatactctagcggcagacaagatgttgttctggaaaaaacaaggaaatttcagcctaagaggctcctggttttttcaatgaatcgaaaccagacgccttaaccttcgggctgtcgcgcacagttgtgatttatatgctataattttgcaacaaagatatctatcgacaccaaaccaaaatgtattcctcaagaattttcttaagaacaatactcgacagtttttatttacagtatggccctttataatacggtaaaatcaacaaatgtacatggaagtcgcataataatgaacgcactatgtacggtacgaggaaaccacagtttgaaatcgtcatatcttaaaatccagataatatagaaacttggggtctttattaaagtagttctggaggtgaagcgctatctgatggtatctcatttaattcaaaatttgaccgctaggtggcactagttggcatggaagttttacttttgttttgcagatatttcaggatcctgtctatttagaaggatgtcgtcttcggcaaagttgtttagtaagttaaggactatcatttttagagctagttgatgcaaaattttgacactaggcggcgctagtgagcgtgaaacttttgtttgcatatatctcaagagcctgaccacttagaaaaatagtgtcttcggcaaagtagttcagtagctcaagggctatcattatttgagccaataaatagggtattttgccaccaggcggcgctagtgagcatgaaatttttgttttgcggatactgcaggatttcgactttttagacaggcaccttcggcaaagttgttcagaagctcagggactatcattattttgcaaaacctagacctctaaggattgaacatagaaaaaaattgagctactgaacaactctgccgaagacaccatatttctaagtgatcaggctcctgagatatttgtgaaacaattgttttatgctcactagcccacctagtggcaaaattgtgaatcaactagttcaaacaatgatagtccttgagttaccgaacaactttgccgaagacgtgatctttctatgtggtcaggattatgagatctgagaaacaaaagtttcatgctcactagcgccgcctagtggcaaaatcccgaatttcttggctataataataatagcccttaagctactgcacaattttgccaaaagcgtcatctttctaagtggtcagactcctgggatattcgcaaaaccaagggtgttgtacaaagtacaacgcgcgactactcgcgttacaaaaattcacgcgacaaccgaaaggttaagcaaagctcgctgcaactacacacgttaccacaggacaaggtcctcaaatatgattcttaacacgagactttttacaaagggatgacacacaaattatgtaacgctaaaatttgactttttagccacctcccgcccccctttgtcacgttttttgtatgggtcctttggaaattttgtaaggcttgtcacgcttggcttgaccacctcccccctccttggggcgtgacgtaatttgtgcatgaccccaaattccgaatggacttaacaacaatcattcggagcaatcggatagcgtggatctcggagcatgatttcccaaggctctgatactatattctacgttctctattatcatactctagagttttctgttatcataaatctcactccaactgcaatgatatcaaacagtagtttggttcttcttatatacccattatcaaagtcaccccaataatcgagaattgatttttttgtatttgaaatattataggcgtatttctcaaccacattgactaacacgacttgctcactaatatcagtgtaacctgtactagatgaccgttgtttatcttagggcttgttcatatatttcataacgctaaagttggccattttggacacccacccacccccttgtgacgctttttgtattgatattttttctgtttttgtacgaaccgtaacatcgaaaggacacccacccactccctctagctttatgaaatttatgaatgagcccttacttattttgtgctaaagaatcttcatttgtacacgggaaaaattctgtggtaataattactattgtagctgactacgcccattcttgaaactaccatggaattttagaccaatttactatgtttacggtacatcccaccatataactggtacatttgacagaaataatttacaacaatctgatttcgactacaaacatggtaaaatcaagcgcatttctggtctgctgaaaattgccggtgcgagcgcttaaggtaaccccctaaaatagtagttcttaccgcacaatttttttgcgtgtatgaaaataatgagaaactctagaatcatgttcggtgtggtattgacagacatccatcaacttctagttcctaaaaaggatacagccccaaaacagattacatcataataatccgtaccaatttgctcattttttttttttaaataatcgaaattctgttagatattgagaaaattcctttgaaaattgtctacatttaagcgttttatgtaatactctcgaaattttattcttcgctttgtttcatatgcattgcattgtgaagaattagcaagcatgttcggattcaggatgcccaaatcagtgttgtgaaaaactcaatttctcacaactcacgtttgagatttttcattcgtgagttgtcaatcacgcaactcagcagtcaaaaaatcatggatgagttggctcacctttttgactcattgtctcgtatttccacagtttatccacacacggcaataatttcttgttagtctggtaaattatgcacagtaccaaaaaataatgtgatttacgtcttttgggatgcacataaaagaagcgagccgaatgacgtaaatttgtgtcgagtttcaaatacgttagtgtctgatttggcaaatgtcgatcacagttccatcgttttcgtgtcctttaacatttaaaattacattttttgttcaatacatcttcaaggacacgtttttgtgccgttccatcacttacatcatgtgtcattcagtcataaccagaattacgtccagagtaattttcattatttttaagagtgtggtataatcctttctaccgttaacaacaacattcgggcacaggcaatatcttggtcaacattctcagccacaacaggattataactacatgggaaccatgattgtcatacagtgctgttctgaataatagcagcacatgtcgattttcatacaaaatgctcaactttgacatgctgtagttttgttccctttcaagcaatcgagctgaaattttctccacagaactacaaatatgatcaattttgtaactacaaaatttcggttttttctgagtccctgccgaaaagtgagacactaggtgaaatttttcaaaaaaatagcagtttttcattttaaaatttttcttctacaaatattttaaacattttcggtttaggtgtaggtttgataagtaggaggagattgttccaatggtaagtgatatacaatttaaaactataatgtcaagccgaaattcaaatttttaaaactgatattttttcgaacaatttcacctagtatctgattttccggcaggggcttagaaaattttgaaattttgtgtttacaaaattgggcatatttgtagttctgtggagaaaatttcaactcgattgcttgaaagggaacaaaactacagcatgtcaaagttgagcattttgtatgaaaatcgacatgcgctgctattattcagaacagcactgtatgtcacaagtgttcgaaggttaacaaagtttttaacaacttcaaacaaatccctaacaagtacttaagcattaacatcactctttatacctgtaaccatttacttcgttttaatagaattcctcgtcaatctgtttattaatgtttctaggtcacggtcgactcagttatgaaaatctagctttgacaggtaatataaaagcacagagaaacagacgtaacacttagaacaaatatcgatcaaaatcatagtcgcgaaatcatgtacgcccaatgctaaaaacactgtagttggccgatggaccaacaggtggcggtagtgtgtaaacgtcaaacacgaacaaaaacgacgcgagcgctgcgggtggtcgattgaccatctacccaatatttgaatcgatggttaaaaagatggtcgatggacagcgatgagagtgtgacgtctgtttgtctgtgatttgggtttcacgagtttttgccgggttttgcgactgaatcattttttaacggtttgagttgattttgcatcaaaatctcaagcgtgacatttgcgaagcagatctctaatgagtttgctctcacgggagagtgtactgattgagatttgagtgtgagtctatcaacactcaatatgatagattttacacataatttgatgcgtgccactagtcctctcttttactctcccgctgtacataagccgtacttaagttggaaaattttcccaagctgtaacaagggcacgctctgttattagagagaatgagtattttatctataagaaaagattgggaccctatagtggaaatctttcttgcatcttccaaagttctgcaatgattattcttccgacaccgaacgttgatacggattgagcaaaaatccgttggcgaacatcagcagcaaaaaagttctctaggaatgttgacctcgggttgatcggggttctggttccggaaatcagataacaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgtttttccatggtatcataacactccaagaataaccgaaggcatgagcaagtcatggtttttttaaaatttcttgtgttacatgcgcggagaggtaaaagagagaagtggcacgggaggcactccttttttttttttggccacttagtaaaatccatcacattgatcaacactggcccaaataaagtatgttgagttgtattcaaaactatacaaatctcgagaacttattcaaacagtctcaagtcaaaaaagtataaaaacttactttatcgatcctacgtgtttcgcaaacaaaattctacacgttcctctttaaaccaactcaatttttcacttttagaacgtttaattttccgatttacaaaacggcttaagtaagattttcatctttcgcaacctaaccaatactttcgcctctccgttgtatggagagataaagtgacttaaccatgaatcaaaacaaaacgattaagtcgattttgagcggttccacgccagatcggtaaacgatgaaactcgactaccttggattcaaatggaattttggacatagtttcgatataatagaataagttttttccacttctccaccagtggaccatttaaaatcaagagtaacttctgataaggacgtatctatttttggcaccaccatttaaaaaaaattgtacctcggaaaccgtttgttatagataaatagtgtctgaggagggatggtagacaatctaataggctttgtaaaaaaatatacactgaaaaaaaatactcttattttcatgaaaaaatcgaaattaaaccttaaaacacaaattgcaaaaaataggtatctttgattttgttcaaattttttcttttcaatgtaaaaccagatgttttaagcacagtttcaacatgatgcaatctaaaataaaaaagtttttctaagagcaacttttggtgcatttctgaaaattcaatttctggccgtagaaaagacgttttgatgctgtaatatgattcttcatccaaaaacaattcaaaacgctaataacaatgatctttctaaaactagccgttttctagatatttaggattcaattatattaatatcataaaacttaagaaaatacgcacgtttcataagttactccagatgctccaccaacaatgttacgtttatctctatccacattaatatcgcatgttttaagggcagtttcaacatggtgcaatttaaaataatttttttttctaagggcaacttttggtgtatttctgaaaattcaatttctggttatataaaaggcgttttgatgctgcaatatgattctttatccaaaaacaattcaaaattctaatatcaatgatcttcctataagtaaccgcttcaaggtatttgggattgaattatattaatatcataaaacttaagaaaatacgcctgatgaaatagaactgatgaaattcgccccagtgatcaatttgtctctggattacagaataaaaagttggtaagattgactcaatttttctgatacagtaaaatagttgctaatgacttatcgatcgagtttataactttttttttgaagaatttgcctacagtaaaaatcttgttccttgtcgatcagccgtgtacagagccggctggataattccccattagtaaagatcttactaataggatcctaaagtcacagagaaacagacgtaacacttagaacaaatctcgatcaaaatcatagtcgcgaaaacatgtacgtccaatgctaaaaacactgtggttggccgatggaccaacaggtggcagtagtgtgtaaacgtcaaacacgaacaaaaacgacgcgagcgctgcgggtggtcgattgaccacctacccaatatttgaatgatcgtttaaaagttggtcgatggacagcgatgagagtgtgacgtctgtttgtctgtgctaaagtcgtcaataccaaacgcttaagttaaagccagaaacacatgtttactcaatttttaaaagtttttcattggtcaaagtccaataaatttatttctggtttttgactttttttaaaagcactttttaaaaaataaattcccagtgcaaattgatcggcaaagtgaacgtcaaacatggtcaaaacattcaaggttcaattttggaccaatttttaaatttagagtttagatatgataaaaccgttatttgagtgggaaaatttgccaaagtagtagcaagggcacgctctgttatttgataatatgaagattttatctataagaaaaaattgggaccctattgttggaaatctctcttgcattcttacaaagtttctgcaatgattattcttcggatcagcgaatgttgatagcgattgatatagaatcgttggcgatcgtcatcgttagacaaagttctataaagaaatgttgacacgggttgatcggggtgttgtgtttgctgaaagtaacaatatcaactggatcctcgagctttcctaaatggaagttcgtcttacaaaagtgcactatggctgtattgttttgctttactctataaagattgatcgttgctgttcttctaagctgaagacaaatctcagctgttgtaaacaacctaaccaaagacaggattcagatttttgcaaacctagaaaaataacagctggggaaagctaataggtatttattgatagaagcctaaggagaacagaatacactaagtaacacgaaattcatattcttatccctattaagccataggtctaaaactgaagaatggcaaccatttgttcagttgctttatgagctatacctgagtaccaagttcttggggacgtgatatcgagttcattcttagactctcgtcgaattcaagattaaagttttgatgcttttctggtgagaacatttttgagtttgatccttgaaggagtgcctggcctgtcttccagtgatttgttataacaatcttggtagattactatcaaaatctttaacaaatcttccaatattatcaacagatatccactattgtcttttaaacaattcttcaaggataaccagtatttcactaattgggtcctaaaatttttaataaaaccatgtttttattttacaacataaaagagcatgttacttcaactactttagcatttattcctgctaaaataacggctatatcatgtttaaactttaatttaaaaattggggccataaatgaacattgacacttgagatcatgtttgacgttcgcttagtcgacaaaaacaccacaggggtttttgttctaacactgcacggagacggaattcaactcaattttggtttgtttcaacgcaattccgtagttgagcccaataactcaatggatcattgaaggtagtttttgcaagtgctcaccgcatcaaaacaaaggcgccactgtatatgggatttaacattgtgacagcattgctgttctgtcaaacacacaaggctacggtggcgctatctatggtttccatagagcttagtgacatttaaacacacgtagactaacatacgctcgtcatacacagtttgtttttgttttcctcaaagaaacttgcacacgctttccagactcaccaaaatgcatatggaaatattacccaatttgaaaaaattaaacccgttttctgcgtgtttttcgagactgagtgcatattgttttcctctaaggttcacaactacactgaaacaagcgttgcagtaatgagaaccatgaacgtgtttttaaatctactattccaaccacgattgagctatcatgaacagcgttgcggttgaaaatactatatcagagggttaaattaaatacacaacgccacttgatttgtgcagacttaattcgcatttatttagaatattttgtgcattcaattttaccatgacaccatttcgacagtaaaaattactatatcatggttaaaaacttgcagcagaccagaatcgaaccgaggatctggcgattgccaagcgcgaacgctagccgctcggctatcgacgcggttggattgagagggaacaaaacgcaaataaaaagcgttcatgatagctcaatcgtggttggaatagtagatttaaaaacacgttcatggttctcattactgcaacgcttgtttcagtgtatctggcatttcggaagggacacggaaaacaaaatacacacaaaatttgagtttaagccaagaagtgtgacataatctaaaaaaacataaaaaaaaatgttttttggacttaaaccaacggaaaacattagaaaattgagtaaacatgtatttttggcctaaacttaagcgtttggcactaaaatcgggacatgactttaggaccctattatgtccacatcgtatagtattgcaaataagtaaaatggcaatatagctaagaagttggcactgttccatttggggtttattgagccccgaatgtcaaagtcccgtttcaatgtcatagaacctcatactttgagatataagataagggtgcatgaaagattaaattttctagggggggcttgaacttttcttggaagtgctgagaccttggcccccctactcacgccaatgtttgagcatttataaaatcagtttttgatgcaacttagacgacctacagctcaaaattctggcgcagctttagatttattactccaaaatatgttagaaacacataatttgatcttttaagaagcaacaattttaattttattactctgtgttatatattgggtttttttttaggaattttgcgatacaatcccatatttgatttaatataatataatcttatgaaacgccaaatactcatgctttgcgtatattttatttagtctacctcatgcttgaagtaaataagtaaacctccttactatggaacactcgtgttgcagaggactattgaagatttgaaagaatttagacattgtgaggaatagatgtagattaatgaaggggacacatgtatcataaaagataccattctaaagatgaacaacccgaattctgatacatttgttccgtttatgcatcagttgacaattgcagaaatagagtcgcatttattgctattaatcactgccgattatactaatagtgtttagcatttaacaacaatacacatttcatgtttaatccacatcgtaaactactgacgtgtaagctgaaaagaccgaaccgaaaccttgctaggctataagtgtaaaaatacaaaaatgaaagtacataattgtttaaagtacatagctaaggagtaacactaacaagcagcccgtttcgaattccatcgctgatagtataatcgcaaatttcacaaataaatgagcaaatttcttaactaagtaagattttaaaattcaacataatttttacaacttaaaaatcgatgctaagtgatgttaaacaaaataaagatcaaaacattgtaactcacttaaaataaagaatcattagtcctccagtaattaacagcaaacaaccagaagagagagagagagagagagagaaggagtaaatttcaagcattcaatgtcaaacgataatcactgacatagatctgtcgtcgtcgcctccatcagtcctatcaaatgtcgaagataagtacataaatattttaccaactaacgattgtacaactatagcgatgtaaaattaaatcaagcatagctccagtggatgagccgtaatgttgcgttgccatggtttcgaaatttcctgtcacatgcgtgaaattcaagcaaaagatcggtgtactgtcacttttcacagtaggcggattgttctgttaaataatgaagccgaggaaaatgacttaaataatcgcacaaaagagtattttcaacttttcaattcatgcaaacaataaatttagcagcgcttagaattaggacgaccagaatgaacactcgctagcattatggataagttaaccattgaaataaaaaagtaaattcaaaagttaccacatacaaagtacttagagttaaacggtaatacagtaatgttaggaataagtgacaacaaacaaaacacactgccattattggggaagaaatttttgacattttattcccacattttagaagcgtaaggtgtacaattagtgacccttgtagaagttttccaatgctccttatttcacctccagctccgtctccaaacccccaaccgatcttgaacatgaaaaaataatccaattctttctataagcccatctcgtaggcttcttggacattaacgaataagatgaaaaaactgccagattttagcgaataagtgcttgtagggagaatttcgccatacacagtagaataaccacatagaattcggtagaggtatctgaagcgcgtggaaagtgacagttctcccaaatctgggcttgtgaatcgtatagcaggcattggcagcgatgtttctaaacgggaggcacgcatccgtatctataaatgtgaacaagaaagtatggtttgcaagtggcacagtgtttccaaaaagtatgaaggaatgtgagagtggattttgttataatttacactagatttcgaaaaatagctaacagcgctataattatcctttgaagtaatgacagttttactagacattaagtatgaaaggaagagttgccagttttgctgcggatgtgatgttagaacacagaccttattcgcaacgatgctcgtgagcaccaacgatatgaaaacgtgtttcgatttacaagaatgtttgctggcgtatgatgcaatgtgttatcatttctgattttttatttgtcctaattagggttgtcattagaaattgacttcaaaaccaaatattcgagccccgaaattattttcaaatattatttgaaattttttaagaaaattttcaatacagacatcatggcattgacaaactgcacaatgttgatccagacaaccaagtgttgatctgcgcaccatgacctcctttgcaattcgtaaacaaactgtgcacgttacaccgaaccgaatccgaaaccacgcaaagttatggtgaaaagtaagtcgttattatgttatcctctgttaaccatcttaatacgactaaagtttctgcgatttctttttatttcaaaagtgcaaaaaaaaaaaaaaaatgaaaaacatagtcgtttacatgtagacatcgaagcgatagagatgtcggcttcgtaaccacgctgcctaccgtccacttaccggtatgtgccaaatgtacatctcatacatccgacggagcgatcatcaggttatttctccggagaatcctttagaaattcctgaaggaattcgtccaaggattccaccacgaatttctacgcgaataaatctgaagattcttcaacgaagtcatcctactgaagttttcagaacctcttccacgaattctaccgaagtttttctgatgtgtcttacagagtttccacagtagaattcctccttggatttcctccgggaatttcccgttgatttcttttaggaatttatcctgggatttgctgcaggaatttctccgaggatttcatctacgaatcctttccggaaaccttacagttatttccataaaaattggatggattggtggatttcctccaggaatttctctgggaattttgtccaggaatttttatggagatttccatcatgaatggagaaaatccctgaaattccttcctccaggaatttctctggggattcacaatagctatttctccggg

SEQ ID NO: 151 - DNA, 149699 bp, Aedes aegypti
  misc_feature (38069)..(38168): n is a, c, g, or t
ttggactgtgagtggcgtgcagcaaaaagtactaaccaattcgattacctattgcctgccgagtacttttgcaccttgtgtcgcaggaaaagaaattaccaccaaagaaagaagtgaccgcggtccgatcccggagtcgaattgccgcaaattagggggaaataaacgccccaaaactgttaagagatttcagtcgtataattggcatccgcgcgcctacactcgaatcgaaggcgatttcgaatgagttaccgagttgttctcggaaagtgcagttagtgaaaattgccaaattggcggaaaagtgatgaggaaaaatgaattaaggtgtgacggtgatttgatcggctagtttttccagtgttttacggtgaaatgagaaagaaataattactggtgcaaactgaaaaggtgctatcgttttttctcccaagtcgaaatgaaaaatcagcggaaaatatgagaaaaaaagttgagtagagtgagaaaatcggtgattgatgctacttgttagggtagtgaagaagtgattgatttttttctttgtgcctcaagataattgaccactccgaaaaagtgttgcgtgtacgcaaagatattatggacagtgcaatggattcggcatcgacggccagtgatcacagcatagcgtcatcgaacgactcccgcggacgcaatctgtcttctcctgcgatgccccatacgcacaacggtggcagccatgtcctggacaaaactcggactccgactccggtcagtccggtgcacaacagtcacaactcgagtctgaatcatggccccgggcgacagatggcctctagtcctttgggagcgacacctcagcagatgatgagcatgccacatccgttaagtccgccacatgtgtcgacgcccacgtctatgggaatggttggaatgcctcctcggatggctggcggtctgacgcacattccgccacatggacttggattgctgaactccttcatgcaccatgccagcccgttggatttgatggccgctgctcatcatcatgtccctccccggtcctacaatagcccgccaccgatttcgagttccgacccaacggcgaacgaatgcaaactagtcgactaccgaggtcaaaaggtggctgccttcatcatccagggcgaaacgatgctgtgtcttccgcaagctttcgagctgttcctgaagcatctggtgggtggtctccacacggtgtacaccaagttgaaacggctggacattgtcccgctggtgtgcaacgtcgagcaggtgcggatattgcgaggtctcggcgccatccagccaggagtcaaccggtgcaagttgctggcctgcaaggacttcgatgtcctgtaccgcgactgtaccaccgccaggtgaggtggatttgttttgtgctatccctttatttccaatatattttgcttcagtgtcctagatcttgtagttgctagatggtgtggcattgctttgatctttgttaatttacattcgttaattacggcatctgctactaacttcctggactctcaaatgatttcccgcgtatatcgttgttatgtgtctctgtgtgtgttgctattttgtaagggtatgcgaaataccgaatgattccgtcaaatacggttcgaaacgaaattccgcggaattccacggaactcgcacaggcgaaatttttattttgctatttcgtttcgtttcgccaaactgttaaaatatttccacggaaaattgaaaacaaacggaataaaacggaatttcgcgaaattcgagtttaatttcgaacaaaaaataggcaaagcgttcgcttctactcctatctacagtcaaaaatgggtccgtattacggatcaaatcgactcatattatggatcagaacactataacagcaaattatctgcgaggcaaacgaatggtgtgctagagaaagcatacgttttggcgtttctttaggaatcgtcttatcttagattcataactggtcggtgttcagacagactgaaccaagtgttttttttatggttccagaaaaacgttccccaggcatgcgaaatatccaaatatttttgttttttgctgtaataaggctgatacaaatattaattttcttttatgtcaccccccccttcaaaaatccgaaaattttgaaggggagaaaaaaaaaaagattcatcatttttttgacatcagttaggttttttcaatttttaaagtaaaaaacaagtaaaataataatccagaggaggttcgaaaaaagtttaacaattatcgttaaaaataaaaattcaaaaaaatatttttttttcatttttatttttttgttccttatttatttttatccccccccccctcgtaccttccaagtagtctcggacataaaataaatttaatatttgtatcagcctaatggaacttatctatttcatgatacatctgtataaaaatagcataggaaaaatcacaaaaactacgaatggaacaaaagtgtttaagcatgttattgttgattgcgatgctgtatagatttgtgcttcgcgtaggtaaaataggttctgcgtaattgctactctattcgatgagatattctccgtttaatccaactttgatccatatctgtgttatccataagggatggtacacaaattatgtcacgctaaatttgaactttttcgaccccctcccccccccctttgtcacactttttgtatgagtccaccgaaaattctgtaaggcttgtcacgcttggctcgaccacctccccccccccttggagcgtgacgtaatttgtgcatgacccctaactgttggatgactgtagtattgactggtccgcaggatatgataaactgcactgccgttgtaaagtttccaaaaacgcccatttgccctaaattactcgcggcgaatagcccaggaaaggaacaactgcgtttgatgaactaccgcaatgttatcttccataagaatgaagaaaacaaaaccacggtttcctccgggaaacatcgcgtgtcctgttgagcaataatatatcaaaaaaactgtttgtacacaaatgtaaaaaaaaagctgcggagcgtgagtccctgatgttctggatttgctcaggtggtgcagattattgatgcgcgcatttgttctctctcttgctttccagctatgacatcacttttaacatagcataagaacagctctcccaaatcaacgcgatttttccgcgatggcgacaaaaaatcgccgcgatttcgttgttgtgtcataaaactctacatgtagcagcggaatcgcagcgattgtttgtcgctgtcgccgtaaaaaatcgcgttgattagggtgatccaaagccacacctcaaatcttaaagagcacaaatctaaagaaccagacgtccattcaagctgaaaactctatcgattgcttactcgatggccaatcgatcaagtgttcagcttgaaccgctgtcgggttcgttagatttgtgctcttgaaattctgaggtatgccttcgatttatattcaccttaaacaaggaagatgcatacattttttttttatcgaaaagtgaatctaggtttattcactgtaccacaccaccaactcctctctccttttataacgtgacataatttcctcacgacccccaattaaaaaaatgcgaatattgataatatatcattacaaatattagaagccaaatgccgcaaggcaaaaatcttaaccttttcaataccgacatcaagtttcaaaattctctaatttcgccatctgtcgatcgattttgatgatttatttcaggaaaaatcacaaataagtttaaggcttaaaatttagtgaaaatgtgattttgtagtcagtattaaacaaagaatctgaaaatgagataatatcgacaatccttaattcttccagaaatcgtccacaaatttgatccctccaagaatccaatactccagcaaatactaaagcaaatattccagtgattcctctgttctatttatttttcttcttctttctggcgttatgttccaactgggacagagtctgcatctcagttaagtgttttcatgatcacttatcgacttgtgtccccaatctcattcattcatgccacaaagcataaagtacagcaaaaaaatgaatatcattattccatgttttatggtatatattagcataacatagggggcccagatagccgtagcggtaaacgcgcagctattcagcaagaccaagctgagggtcgtgggttcgtcattcattttggcaacaatgatgtcttttcagcttgcctgagtgataaactatgtcttgatagagaaacttaaaagtagatggagtaccgtgtacctttaaattccgctcctaaatgcttatttttgacagatacgcgtatttcgattaccacttgcggtcttcttcagtgtcagttactcgtatccactggtatccgtatccacacggtactccatctacttttaagattctctatttgagattctgctcagaggattcgaacattcattaaagagtatgtcttgatagtttatatcgacttgaaaaagtatcactgtacgcgctaacatgtataaagtattctgatactttttcagctgtgtcagttcaaaactaactggttttctttgattcgaaatcgtgagatgaatcagcaacaatcatcaacgacgcgtacaaatttcggccatgacggcctacttcgcattaaattaaacccactcattgccttgtgtgaatgtcagatatattgaaatgaacccttataaagttattaagaaaattccaaacaaacagaaaagagacttaccacaacatgtaaggattccgctgagcaacactaaggtttccatatggtagaggatttaaaatacttttttatgcccatggtcaaatttccagattttgacatgaaaaaaaaaacttaaacgtgtatttcgcgaaacaaattcaaaaatttcgtttcgtttcgaaaaattccgtgagatatttgatttcgtatcgagttacacgaaacatttttaaatttcgtttcgtttcgtcattatcagcgcaagatattccgcgtatcgtttcgtttcgtatcgacatggaaaaaatccatatcgcatacccttactattttgaatgattccagttatggaagctttttcgacgaatgcgatcacgatatgacagtgtaattagttctccgatgaaggacatgtacatgtacggcgataagattggactgaaagggtgaaaccaggtcactgtaatgagacgacgtgaagccgttaggcttctgcgttgctttacttgagttgacagtcagtgtgataaatatttttttagggtacatatatcatttttatcaagataacagcataactgtcattgaaaatatagaattttttgtcgcagccattgaaaaaatttcgttgatttgggggagtgttaaaatgaatagcataacggccttcttcttctaacaaaacaaacagtgctgaaaagtgctacttttcagtactgtattggagacagccaattaattatcgatgtcttcattcgtgattcattaaattactctgggtttctcaatgtctatgtgaacaagctttcaattttaaatccattgggtgatccgttaccacaaatgagccattctgattcgaaatcggttcgtgcagtgaacgtagaagtgattgttgagtcagtcccaaaatgacgctcctgcattgtttgcttagaaagttggccacataattaataactacaacagagaagaaaactgcattctgcgtcaaatgaattaagaaaatagatccatttgagtttgagtgaagggagaaaatttgtgacactcattttttttgataatattgattgaaaattccaaattgcttcttcgcatgaatgtccatgtggattattttcttatctaataataacttctaagttccctacgggatttttttgaatttcttctcgtttgtttagagtttcttcaataatgcaactagaaattgatctaaaaatacattgagagatttttctttaggaagtctgaacacattcttccaaaattttcccaaacaagttgtcaaagaagtcatcttaattttttccaagaacgtctccaaggagatgctcaggaagtttaaaaaaataattaaaggtaatttctgaaaaaaaaatccggtcgatatttctaaatcaaatcctcaagatgtcaccgattttggtaaaatcgatgaaaaattcctacaagcttctcttttttaaagatctctggatttttttagactcttaagaaagtctggaatagctgacaaattaattttcggaaagttttctaaaccttgcattatttcctacagggttttctagaggaaatccctggaaaaaaactcgatttgaactcttgaaggaataacgggaaacagggctcattatagcaatgtttccaaagcagtttctggcttccttcggctcaagttatagagggccccggatatttgatggtttacagaacaatgtacttttgaatccaaaacatgacgttttgttaaaacttaccgttctataaggttcaagtaaacgctatttaacaatataactggatgctacaagggcccctccaaacctgatttttaaaagctttttttctattgctatgggaaaaaatactcaaatatttatttcaaaataatcctcttgtactgattgaaaaagtttttggagaactgttatattcaataatgcactcgttcagacttgcaaccaatttgtcaagaaatattttaaaagacaatccaaagcagcattttctgtgaaattcattgaagaaaataagactgtttgaaaaatcttctgggagaatagttttttttatttttcgggaataaaactaaaaaatctattgaggacatttaggttatgctaattatctatatatataaaaacggaatggtgtttgtatgtcacgaaatatctttagaatgagtcaacggattcacctgattctttcacagttaggttcgtgaagttttcagacgtgtcattatgtaaaaaacaggtcgaaaaacttcacgggaaaattgagataaacaggggtaggtacatttttgtcgaatttttttaacaatatcatacagcctacttcgggaaaaaccaggcttgtcaggtcaactagttttgaataatttggattacataggagttcgaaaatttttgcttttacttgtttcataatgggaaagctttctacaaacctacgcttctatttcgcaagttttgttttttcaattctatttaactcaggataaccgggtcagctggattacaatccggagccttgcaaatcagatggggagatttctgattttttcaaatctctcgtgcgggagttctcaaatgtactgtcaaaaaaacttacagaaaacatactaaaagataaaaaattcctagcaattttaaaattcctacagatgttttgtggcatcataagttcagattgataaacatgtctggtgccatttcagagttatcacatttgtaaagattttttaaagactttattcccactattaaagtatctgtctaaattttattcattggttttctgattttggagatatttcaaaattcctaggggaatattaatttcgttttatatatagaaatcgttcgtttgaactgcgaatgtttccatcctcgtaatgaaacgtgtcccctaagttcgaaacaagcaatcaccaataatattgatcatatagcgccaaatattttgtaatcgaaatacaatcaatcgacgaaatgcatacttgatggcgataaaatgcttccaacatttaagtgttagttttgatcgtcttatagtgttaagaactgcaaaccatcgtgattgaagggttcaattctaaaattgcagtagatctgttaaaagcaaatcaatttcaccagcattttgataaagacctcagagtcgtaagccaattttaggaattaaacgggtagaatatggggtcttttctaggtcgttttataagctttttcattaagacaattacattatatgagtgtgaattacgaagacctttctaatgcaatatattttatattaatgaaatcgttatcgttttcctgtgaatctttaaactaatgttctaccatgttatgaaaataagagatttaacagaatgcctctagttgaaaaacataaaaaataaaaaaaaaaaactccaaagaaaagctgtcttcaaagttaaacattatttttcgcataacaaaaaccctatttttttaaacaatctatatgttggtatcctatactaatccaatgaaagtagagcttcaaactatcaacaatattccatcattatttaacactaggtgactcttatgattattaccaagtttgctagaatacaatccttttatcccagcaaaaaaaaagtaaagcaaaaagcgtgttcaaaattgattaggattacttaaggctcaagcatccatcatttaatcatcaacaatcatcaaaaatgaacaaccagtttcttcctccaaatttaatgaaatcttcatgaaaatctatcattgcattacagatagcaagtgcaatgcaatgatagatttttatgagcattgcttcaattttgagcaaaaaaaaaatggttttgaaaatttgtaaaacgatgatggtttttttcctcttaagaaactatacttgtacaaaggagaactaaatcatgacttttgacagtactcttcaaaaaaattacttttttttaatcattttatgtattttaaaacatgtacgcatattaaccgatctagttatttgtaaacgtttttctattaatttattttggtcgcttttttattctccgaacatcgtacaatacgtagggtaacggtcgtattttggaccccctaagaaagtgattttagttttttgtcccaattaattaattgcacagcataatcaagtcaaagaacatgccaaaatgtagagaaaaacttcctttacgagacaaaaatgctcatacggtcatgtagggtccagaaaacgtcgaaaataatagaattgtgaagcactgtttttcattattttggacacaccaatacattttggaccctcaaagtatatattttggacccccggcatttttttatcgtttaacgacaaaatccacgacactggttgtatgatatgcttgcccatagtctaatcaatcgattgacaatggaaaaccgaaaaaaatctacgcctttggttcagaaatttgaaaaaagtttttgtttacatttgaaaaatttctgacggcttcattttctgcgtgtaacgtgttgtaacggttgcatagatgaaccgattaaattaaattaatttcagataaaataaacacattttctatgtacaaacggttgatgcaagtgcggaatagtcctatctttccaaatggcatgcgaattgagttggtcttttgatttgaatagggaaatttgcaggaaaatggtcccgggggtccaaaatatataggggtccaaaatatattggttaccctattagtcgaacaatgtacagaagacggattatgattttttttttgataaataaaacaaaaatagcaaacacaaagtgtcttctctataaaatgcacagtcattacctcttcttaagactgaaagatttaataaaagtgcaaaaataagtgcactcataaaaactgtttaagtaatcttttgaattttctctagcactcggctagacattatggtgctaataacattctatgacattgtgactgtaatggcagctgactaagtcagatgagaactatgagatcgagtactttgtgttcaaccgcacaaatgacaatatattattctacttttttttcttgaaaatttgttcattaaaagacaattgcaaataacttgccaaaatcaacaagatgggagcaagtttatctgcaaaaacctatttgaacctaaccagagcattcaatttacttgtatcaacataaaattatcgatacggaatttgaatgattcagatatttttcaatcattgctgccgaccatgttacgttttccacgtgattgtgcagaattaccccacgtcttgagtattccatctttgaaaacagttgccaatgtgaatcttgatgaaatttttatcactgaatcaatgagacacagcgtagcaaaaataatattcttgcgtgtctcaaggatcaaagtatgtgtctccagaaaatttgaagctgccgaatatggtgccgttttacgaaatgtccctacacgtcacaattcttagctacaggtcgtaaaaattgattaaacgctgaccgtattgatgtttacatgaaatatatactacgatttatcaaactttttagaaatcttatcctggtggaccaccaagcatacaaataaggacttcaaccttcatttagcgctcaacgctccgtcattgtaatcatcgtcatcatcaaaacttcaaaacttaaggatttagattaagaaacagtcagtgggattacaataattcgtgacagtgacaaataaaattaaataaaaaataaataaaataagagcagttcttctgttcatattttttttgattttgaacgaaaaaactgcttttgaaaatttcgaaaccaatgacggatcctgcccactaaagataactgctcgaaaaaatttagattaaatcgtttttttaaacatgttttggttcccatacaacttttttcgtttttctcatatggcaaaatacaatacttttctaaatcatcaaaaaataacttctaagcatcgaaaaaattgtaaacttattgttgtttaacaaatgaagtttggattcggtgcaaattaagcaaataaatagccatacaagctgtcaaacttccatgctagttgaccaaaaacgacaaattttgcagcttatatctcaataaagagttctgcagttcgctatgacaagaggttcaactgaaaattctaagtagaatagatttgataagtgttataattaattacttctggtttaccgccgaaaattttatgattttgcacaaagcttggaatgttgcttatattaggtatgataatcttctatcatttgacccaagaaacagaaattgaacgttgactttgtcgtgaatatttaaagctttgcctacaatacaaggactttctatagagattttttaggtcattcagatcattcttttaaagccgaacatttcaatcatatggtgattccctataaatatagtattttcaacgttcctcgaaaataccttatttggcttatcataaactgcaagagcatctgaggatggcaacccaatgaatttattacatcagtgctttcatgttagtataaagtgcgtgattaccgagtgaacagtgaaaaaaagcgagtaatttgaaccaaaaagatcccgaacaatgtacacgtacacgatgaatgggaaataaatgaaccatttgactaaatcctcaacactactagagaccctcccattctaactaattggccaaataaaattcgcttcgacctcgtacttgcgtcggaccccaccatcgctcccgattctccctctatacattttggtcccggtttctcccccaactagacgagaaggtgtgcaatccgtgaaccagtaaaagtgcgtatcgcataacaaagaatatgatgcacaatttcactgctctgctgatgggtgcacaacaatgaattcataaacccagtcaatgaaacaaaggtttcgtagcaaaggctaacaaaaaacccggctgactggctgaccatcaccgatctctgccggccccaataccaaactccatccccatcgacgatcttttgggacgggaaaaatattattgtgacataggttaagcgtacgcatcagttgtctacccgaaaaaaagtcaataaaataattcgaaacaagcaataattgggtatgaattagaaattgtcgaaaagaaatcgcaaaaagaaataaaaacagtcaaaaatagttattaactacgagctttctttgtcgaagttgccattttcgcattcgtatatcgtgtggcaggtacgatgatactctatgcccagagaagtaaaggaaatttccatcatgaaaaaatcctggaccgaccgggaatcaaacccagacaccttcagcatggctttgctttgtagccgcggattctaactcctcggcttaggaaggcttcaaaacgcagagcattcctcttcattaaatgctcgataatttagctaccattcgggactcggaagcagcggagaagagcctgaaaaagcgccaaagcgaattcgctgctcgcgtttagcgcgtcgctgttttttcaatttgcatgaataaagaatgcactcgataattacatatgattcgaggttgtgtttttgctttctcacctgtcaattggaagtggcttgtgtgaggaagctattaagcattgcttgttggcccatgtttgataccattgcattgaatgactgacgactgactgactgactgatgcgaatggtaatgttgctttttccgatgctaccaggtactgttaactactaagctaaacgagtgggtaagcttctgcacaatttaatgctctctctagcattaacgacgatgacggataacaagatagggaatgagttgtgcgtatgaaatgcgtgtccctcttggacattgagtgacccttgtcatcgactttcttacgaatgggtttcggttagtgttcagctgtatgtcaatgttttggataacggttgaaggattctggcaagttttgttctccgaaaatttgaattgtctaaatttatttaatgtctgtatttatagcgaaatcgtctttagcgatgtgcgatgcttatttgtgctaagtttttgtatgagatggtttcatagatacgcctccacttttggaggcgatatattttcaaaatttttgcgagtgtatcgaactaacctgccatcttgtgcgacctaattaaggatattgctgtttgcatttgagatgcaaatcttgactaaacgtaacacaaaactatagaaggatacctagcaacgattacataaatcaccgccgccctagcaagaaaaatctagctctgacatcgcatttcttgtgaaaaatcttacagcgtttggtgttcccgcatttgaaatttgcatttcaaacgcacacagcaataataaagttgagttgacagctgctatggattgattcgccttttttgtacgtgtatacggaatgaaacaaaatgaacaaatgaactcagtaaaagaaaaattggtcaatcaaacaactttattcattatgttgtgtgagtgtgatgttattttctttaattaaacgactttttgggtgaattctcatgctacttctggttgtctgggaatgctattgacacattccaaaaatatcaactcctagataacaaaacatccataaaatgttcataatatggaagagaaaatttaaaatgatataaataaacttttatttcatcaaaagtaccatgaaaaacaacgcttgaactgttgaatatttggtgaaatatataaaaaaaatattgttaggatatgtgatatttaacattcgaatgaagtcccacattgtcgtaacaattcaataacaatttttattatatgatgaacatgtatactagagtggttcaaaatttcgttactgcttgatacttcatactgagtatcctcctaaaatttcttgtcttgtttggatcagaactgggactatacaagcccttcatagtttgtacgagaattgcaatgggaaacccatgtgttcgttcattcgatcatagtactttcccatttgcgccagatgattagtattgtgctgatactgtcagatacagttatcctctacatctttaccaaagtcattctaaaatcctacgtcacagtaattaaataagaaaaatttatattttaggcaggcaaaatttttgcatctggcgcgaagtataccaaacacaaataacggcctgtagagcagctcatttactacacagctaaaaatatgttgtaaatttcagtttattttcatgcacatatttggagcatccaaataaactggaatatccacgacaattcgcttatttttcaatcgaatgcactttaagatgaagatgaatcgaatccaaacctcaaattttcaagggcacggatttggagaaccaaacatccgtttcagcttaaaacctaatcgattggtcactcgctagtggtgttcggtgttcgattctccagatccgtgctcttgaaaatttgagatttggcttcgattcatcttcaccttaaatttacacgatcatgtaacattcaaacatcttcaattgaaaattaaacatgatgctgtaatagaagatgaatttggtatactttcactttattcttcagtttacactacattgaatttaaaatatttttaactgtatatagctaaagattttcaattcaataactaattactgagatgcacgatttgtaaacggttattcggcaaaagtgtagctgatacagtatctgatatataaaatgcaccaaagccgttttcgcataccgaatggtcaactgcagagaaatatatctccaccgtttctcaaccgattctttttatttttactgtgacgaactacaaattatctaaatttttgataactactgacaaagttgagtgaaaagtattgattcaaattcaaaagataagttggcaaaaaaaagtgcgataatcatatctatagctatcaaaatttgaggttgttcgccacaataaaaataaaaagaatcggttctagtaacgacggagatatagttctctgaagttgaccattttgtatgcaaaacggctttgatgcattttatatttcttatactgtatctaacaatataagcacaagatcattgacatactctttccaacgcataataaataactaatctggatcgaaaatttttgaggatggatattgccatatggtaagaatttatttcatttgccaataacatagaaaacaacgcccagatagccgtagcggtaatcgcgcagctattcagcatgaccatgctgagggtcgtgggttcgaatcccgctggtcgaggaacttttcgtaaaggaaatgttctcgattcccagggcatagaatatcttcgtacctgccacacgatatacacatgcaaaactgctctacttccatcgacttggcctgctggaattttcttcagggagtttcacaatcactcgtaggatccgtgatcataggtgttcggaactttagaatgatgccaaatgttatgcaataagcaattcgtattgtttgaaattgtatttgaaaattgttgtttgccttccattgtgtatttgtattagttgtttttatgttaatatttagtttaaaaattaaatttcaatgagatcgttgtaagatcagttggaataaataaataaatgatataaatgaaataaatgaaaaatggtcaatcggcaaagaaagctctcagttaataactgtggaagtgctcataagaacactaatctgagaagcaggcattgtcccagttgggacgtaacgccagaaagaagaagaagatagaaaacaacgctttaaaattaactcaacctacaaacatagaaaacttatcgtgacagtataagattttaacattttttggcttaatttattgataatactttgcaaaatttggcattgcaataaccctatcttcaacaacgaaatatgtttaagtatcgaaagctttctgaatattaaatttcgtttgaacagaaatgataacgtatgttatatatgtattccagttacagttaccccacagaaatatggatcagagttagatttcacgaagaatatctcatcaaataatcaataaaaaaacgcatggtttcactaaaatacaattcatttacctcgcatctaaattgctgttgtagtgttctgattcataattgtgagtctatttcatcaagaataaggatcctcctttctcactgatccacatatgtggagtgcacagcgtttgaaatttctggaggaatcgacactttttcgcgaatttttcgatgtattctcaaaaacaactatattctgcagtgccaggggagtgattttgttttatgcagcgttaccatgatttttaatcatattttattctgaaaaatgagtcttagttgatccacatctgtggggtgactgtagctcttgaatcattgaaagtaggactgatcagttggctgaaagtagaagtaatcagttggctacaaagctggctggagttggttaagactaaatcaattgtagaaggatttctagaagagaagttgggatatcaaggtattgaattgaaaagaatcttgaagagaacttaccgaaaaaaatcctgtcgttgaaattggttagagaattgcctaacgaggaatttttggcattggatgtttgataaatgaccaaatgattagacttatagcgagtcaattttcttaattctgtatcaagcagatgatattgctgtacagtgtataagaaaggcaaatggacagttatgaaattgtatttactgaaccgtgtttcaaaagaaacacccatagtgtcaaaaactttggtttgaacttacttttaatacgcttaacaattaacccctctacatgcttcatatagggtttatcatttgtagattcacgagagtaaaatttagtagatagggaaatatttaattcttaacctgctttgttatatggttatcaatttttccccagtgtgtcattttcaatttttgatattcaaactaattttatgaaatgttaaatattgcttgattaaaaatcgattacagtgggatttcgttttcgaaattttcacttgccaaaaacggaacagtgctaaaaccataaaccaattttcctgactttttttttcaatttcgttttaaaaaatatcagaatgttttaacatcattctcacgaaaccatatgatgggcaaacttcgtagcggtccatatagaagcagattctcgtagggtaggactatgctatgaatctattgttccgttatgttaattatgacagacaaatttcattaagttttaaccaaaaaactagttctaatttttgatgatttctgattattgaatgatggattcttgatccttaagaagctgggcttgaataatatctattgagcgcaacttctcaaacttaacccaactatctgaaatcaacgaaaactcataggtttagaggaaacccatagagctcgatagaaatcttgaggtgctgcgacattgctaaaaattctcaagtcctcaaaagtatagttgaactttccaggttactgctggctatcccaggatttcgctgagaaactcttcaaaattaaagattttggtaaaaatatttagaatactactcaaacaatccacagtatcccgctttaaattcctaggaagcccaagaaatcatagaagtttattaggaattggtagattggtgatttaaataaaataatattcttcaggtcctgcaaaaaccccaaaagtccttaggattatgcatccgctcagcatcttcaagaagcgcgctagaaattctctcaagcccactacaaaaacctaggatcacttatatgatctctgttctgatatttattgtttgattttaattatatttttatcaaacttcaaatgacgaaatcaacggcgaggtcatacatttttctagcggcttttaatttaacgtatttctaaaatctactttaaaaaacgtagcttacttaatgaaactccataaaaagttagcagacacaattttttgatccatttgttcctattattgcaatataatattacttgagaaatttcacacacgacatgcatttaattcagcaataaaaagaacagtgagctgaagagacgagacgaaatttatttgaaactttctgtaaataatacactttttgttgctcttgtctcaccgcctgtgttttgttcaaacgatctgtcacaaatctgaataaaaaggattatgacttaccggcactttcaactgggctggttaaacagtatgaatgcctaagatgtggttttcgatcactagtcgagttactagagattaatgactttatgaaacttctcgaaataaataaatgcgtacggtagccctagtagggtctagaatttgggggaatatcgactaagatgcagcctcctgttcatatggctaaaccaacagacgcaatcatatttgcaaaagcatgcaaattttaattttgttgccaaaatcgaagggtgccaaaaacggaatcctactgtacataaactgataagatcaatatagtactgattctgttatttgacaactagtggtcccggccacatttcttgccatcaagtaagctgttgaaaaacgccacgaagcgttccgtacaaaattacagttccattactcctatttttcagacttatccgttccatatcttgtgtaaaataattttcaaacttcgatagcccattctcaagccaattcgtgacatacaaacaccatttcatttcatcagctattcgtcaagaccatgctgagaatcgcagggttcaaatcccacccgtcgagaatcttttcggattgcaaactttctcgacttcccagggtatagagtatctgtacctgccacaaaatacacacatgcaaaaatgatcagtcgacaaagaaagctctcagttaataactgtggaagtgctcataacagggtgtctatccaaccgggaaatccgggataagcgggagaaacttgtaattacgaatgaccgggaagaatacgggaaattgtagagcacgctggggaaatatgtagttctaacattcaaagtttcaatttgaagcactattcgataaaccaaagaatgttgccataaagtgcgcagctgtctggcagcttgcacttcgcatagtgaccaactattggtgcgcttcggtttagatagaaataaatcctgcaaaacacaatcgttggtttcctggagaattttttacaatttcttgtgaaatgttttgaagacttctggcgcctgtagatatttatcaaatttaaaggagattttatggaacatgactgcaaaaaaactctacaacagtactcagggatttctggcaaggttattgatgagatgctcgatagattacatggcaaattcgtgaagagatcttagcaagagttccaacgagagttcaggcggtaattgaccattcacttgaaagttctatgaaaggaaacgtaattagtaggttgcttaaaaggttttagtggattctatgaaacattcttggctgatatttcttgaaattcgtaggttattcgtagagaagggcagaaatcagagctcaaaaggtattcttgggacatctaagttgtgtcctactgaatttcttgacagttttattgagaattccttttggcggagtcactgatgctggttcgttatgaagcctttgttcgataactacatagtttgactagtcctatggtaaagactggatgaggctccagacgggatttcatgttaatttctgctggttcacagcgaattcttgcagccattctcaataaattatgagatccttatcatttatcgttcatatctgtttgtctaaaaccctttcgaaattaaaactgtttttaatccactgtttttgaaaaccttagtcaaaattactgcaataaatccatattttgaaaacgaatattttggaaatcaaatcaatccaatacattctgtcaaacgtctggaaaaaatccagccgcaggattattttgtcatccgtttttaaatttttagggatccgggaatatccggaaattcgtaaactgatttagaatggacaccctgtcataaggttactaagctgaaaaggctctgtcccagttgggacgtaactccaggaagaagaaaaagtagaagaaccccaattggtgctactcttcacttcctcatttgaatcgaaaagcttgaggagcctgcttcgatttgctgcttgaaaaacctgtctaaagcatctaactgattgtttatttacattttttaccgatttacaaagagacaccattttttgatttttggcacgtttagtgacagttttaaatctcactttttagaaggatgtagtgaattctgctgttcgtttgttgtagcaatcaatcagtgaatattcggtttacaaagttttacaaggtttccaaacgaaaaaaaataggtacgggtccaaacaaggatgcaaaaataggtattttaaaatacattcaactctaccttgctcgatatttcccctaactcgatggaatgcgcggtcccttaaatctagcatactttgatccctctataagtcgatacctctctaattcgaggttccctaactttatgcgatctctatcagttccttatgcaagttcacctctttcgatatttccatgatagttttcaaatatcctccaaatattataaactttcgtaaaattgctaattatggttatactgatagtaaaatgaaggttggcaagccatttcagggtgataaaatgtgaaagcaagaaaagtgtcacattgataaatgtactaaaattttatcatttttcacattttaattattatgtgaatgtactttgtcaaaacaacgaatatattaaaaaattaaatatacgtgttgagaaagttgactaagtagtaaaaagtagcactaagaagtgctgttttattgtttaaggtagtttcagaatttccaccagcagaaagatttttgtgcacagacttgttctacgtagagtgtccatttcccggccattttggttgtcgggattcgggacaaaaattaatgcttgtcccgggaaatcccgggatcccgggatttcttagaatttcgttaaaaattgtattttcgttgaaatggaagtaaaatttcaactgtacaatgtgcttacaattgaatttaaaaagagagattttttttaagatgaacagttgaattaaaaaatgaatcacaacacatttattctaatgaagttacaaaaaaattagatagttaattatgggtttgttgggaaagttaaggaattctctattaccttggccgactctgattcaaaatgagagtcatgtcgattttttacgtatttattactcatttttttttctaaatgattgagactttggcatacctattaattggtctttagaattccatgacaaatgtgaattaaagttgcacacataaacaacacagctaaaaatatgttgtaaatttaagtttattttcatgcacatatttggagcatcaaaataaatgtaaatttcaacgaccaatccattatttttcaattcaattcactttaaatttacacgatcatgtaatattcaaccatttttagttgaaaatttaatgtatattaatttaaatttacatgatactgtaataacacatgaatttgttttatttttacagtagacttcagtagacacattgaaaattaaatatttttttctgtgaatccaacataatttaagaatgcaatcgcatgatgccaacgtacggtattaggacataagcaactgtgagttccttattccgtttttcagccatgtttgcaaaatagctgaatgaaatttattattggttcaaatgttttaattatgattaacttcgttagtttaatttatagtcacccgtcaaacgggatcagatgcacggtatttggaacaataacatgtacaaatagcaaaattagatatggtaaaacaatttaatatagtgcatatgaaattgcttgtgtaaaatacataaagggcgatccattaattacgtaagacaattttcggggtttttcaaaccccccctccccccatggtaagattttttgtatgaaaattaaaaataaattgtatggcgcgtaagaaatctcaaacccccctccccccataaacccttacataattaatggacagtccctaaaatggttgactatatggtaggtgtccagacataccaaatgtttatttttatgacacctggatttttttttttttttgatgatatttctgtacaaaaatagcatcgaaacaatcataaatgatggcgttcttactgtttctctagaatgtcaaaatatcatctagtcagacatatctgaacatatcatagtacaattaaaaacttgaaaataatcatatattatttttctctgattcttgaacatttaagtctacaatttgatccaggaaatttaaaaaattttcatcattatcttctaagtacaagagaaacgttttgaagcccattgaaagtgctgtactggatcatacttgaagttaattattataataaggggaaccagattggcttacagttatgataactacaaatgttgtaaagtaacgcaataaaacaaaaatcgcttttactaatttggtaatttagtatttttatgacaattcttacctttttgtttgctctcctttatgaggcttttcttttttatcgaataaagtttgagtctgataaaaatatcaatgttttgtattaaaatatactggtttccatcaaattttacattcatctcgggaaatcccgggtttcccgggacggcaaaattaatatcccgggaaacgggaaatcccgaaatttaacaaatcgcgggatatcttgtcccgggatgtcccgggatggacactctagttctacggtatccagaattacaaaattcgattctaataagttgttgttccatcatcaacatttctcacgcaagcagacgcgattagacgtgtgacaaaaaaggcttaaaactatgtttgcggaaacgtagaaaacagttcaggtgttgaccaaatcacacaccctagacagcccctaatctaatcctcataacctataatgatgatcgggagatacaaccagagctatgaatggcaggctgacatcgcttcgcctcgcagatctgctgaagagcggcaatattaataacacacaactgaaaatccatggcttccaatggtgtaaacaagggattagaagcagaaagatttcgcgctccaatggtttttctcattacacagagtgtgcctcttgtatggctcttcggtcttcctcggtgtgtgcgcgcggggataaaggtggctctgagctgagctgtacaacaatgtgtgcctcctgcaaaatccaacagccaaacgccatgctgaccgacggatcgaccgtacagtggttcgagggtgaccaaaatctctaatatccgtgttttctgaatggtaatatttttcttggcttccttaacatttttgttgttgaaatccaaagtttgaatctaattcattgaattttcgatttcatacaagtggaccgtgacatggttttcaatgatgaaaataaatctttgagctgtttagtggaaaacatataaataaatggaaaccgaatttattactagggtagatgtaccagttgtggacatagtggatccctatttcgacatacgagattacttgaatgttttcacattttgaaagatttgttgtgttgtagtagtaagatttaagatatatcttgatgtttaaacattaaaaaagatttaaaatgtgaaagtgatcggaattttacatatggccaaatagggaaccactatggccataactggtacactttccctataccgtttaattccactagagtttcctttgacagatacgcgtatttcgacctcaactgtaaggccgtctacagtgtcgtgtactgtcttctagtccaaaagtcagagtgagagtttgaagtttcgaccgtcatttgttctcgatcgaaccactgtgcgaccgctgttagaagatagtcactcgatgggcgaggagacaaacgaggagtggaaaaatgaggcacagtatttttatcgctcatttgaggcgcaggcaaattcagaggtcgccaagcgctctgttcttcggttagaaatgttgagcatctgtgcgagcactctggaattatgcttattatgattatgtgtgtggcggtggttgttgttggattgtacctatgaggaaacaaaattgtaagaatgcatgttttgtactttttcattggacctatcggtaggtaccactcgactcaccctgttgttgaattggaaggcaaatgcattcgccgcgccgtttgaaagtgatttgtttctcggtaacaaggggatgaaacgccacggcatatttttttgttcggaataaatgtagcttttatttgtgggcttacgtaaatcaaatatgttcacagttgcagatggatgatgttgtcgtcgcgaatacaacgctggtacacgcaaattgtatattagtcgagaacaaatatggtacattgtgctagaagtatagcttgagtgacaatttttacatgcataaatcgtgtggtaaacacgaatatactctatgctctaggaaaccaaacaattttccttgcctgggtattctggagcgacgggatttgaacccactaaaacataatgttttggtgggttcaaacgaatcaattgattaaatagtatcgatatcttcagaagcatcaagattcatcacagtaataaatcacctttcacgttccttctcaacaccgcaataaattttcgacaaaatacccttcaaaactgacgaaataatcagtaactgcaagtaaaactgcactcagcctaatctgcaacccttctaagcaacccacacgtcggtggaaaccacattcgtacgccctaaaccgcagccctttcgaaacataaaacttcaggtgcctacaattgaccaacatgcagaacgcaaatccacaattgcgcattcgattcggtcgctgcctgccgttggtcctttggtgccgcttaggattatatcgaaccccactggatcgcgatccatcccctggggcttgatagctaccaatttctaccgcactttacgtcgtagcctcgaaccgaaatccaaatcctaatcagcgttcgatcgcattcgtctacgtcccactcgcaaatccactgaatctacatacatctatcaattgcaattgtctgccagcgcagtccgtcaatcgacggtggagcttattatccatccgaaagcctcgaagtggtggtggcgcgtagagatatctgtccgccgtcagtcagttttgttgccaccgaaaaggaagcattggaaggagccacgaccatgcaggggaaattcttatcgcttgccacactcgaactcgaaggctccttccctggatggatggaatggatggattgctggttgttcgctggtagcatggttatgcgttaaatgtatcgctcagagcaaaatagaatatctactgttcccgcttctactgccagctaagcactgcagcagttggcttcctcgacaggcaaatcatattagtgccttattgtgctgttcggctttctcgagtgggttgatttagggatcgatacacgatagggcaagtttgttctacagcggtgccccgtaatatgctgtcttcatatggacctaaactattcttcttcacgacatttggactctactggagcagagctcatttctatgcttactgttcaaaaagttttttcacaatccgataacccagtgatttctttgccaaagtttagactttctgtacgtatgtcatgtggcggacacaataagtctgagaaaactattcaagaacaacttttttacacacatttgaagcatggtttagaattttttgatcggatgtttcatgaacggcgaagaaaaagcaaaatattcataaacatgttttaaggatatttcaagtcatccaatatattatgcaatatctacgcaaagtattctaagaagcctcaataaatcactagaacatcgtgagtatgtgtcaaatataaagtattatattctgattttaaatctttcaatgcaccagaccaatccagactttgaaggttttctttctgttcaaaaatgattacttgtaacatttatggaggtatataagatattcagcctttgagttcaaatcattcaaacttccagcgcaaccaggaacttgaaagtagctccattatatcggtagtttttaaactgcggctccagaacagattcttaaaatcttgatcaatttgtttgtgtttctccgtgttaattaatataattactatcagtaactgttaagtaatgtattgctgtgtgcatttataactcacatagggtaaccaatataattttgaccattatatattttggaccctctggatcattctccgtgataaatcccagtttaagtcaaaatagaaattcagttcgcaatacatttggagagataggactgtttaacgcttgaatcaaccgcttgtgcatggaaaatgtctttatttcactgaaattaatcgcatttcgtcggttcattcatgcaaccgttacaacacgttacacaaagcaattggagtcgtcagatttattttcaaatgcaagcattttttttcatttctgggatactaaatgtgggaacaccgaacgcagtataacttttcacaaaaaagcgaaattcaagaatgattttatttgctcaggtatgtgcacagcaaaatctagccaaagaagaactcaaacacgagttttgtttattgttttcctcattaataattacaataatgtttttttctgcatattgactttgagccagttttccgtaatagaatgacgcaaaatgaaaccagaatagaatgcgtgcacttctggttcaaaagtctagagctatttctccagacaatcccttatttgcacttgtcaattaattttaccagtggttatgaggatcatactattcataacataattgtttagttgtgcatagctttttttatcctgaaatgatcattagccttagctcgtgtactttaacgagctacacaatgcaaaacttggacgatgcttcaagtctgcttttacgtttattttattgtccattactgcatttattactgcaaaattttttcaagctgatattggtttttcgactctattttgaaaactacggtgaaatacccaaacactgtattttgagatggtccccagactaccagaagtctataaaaatttacgtaaaaactcgttaacttatacaaataacatcaaacccgcagaaaacggtgacagaaatcgttggagtgacgagttacatcgcaaaagacgctattttctgagttcatcagtgcattttgtttcgttccgtatatacgtacaaagtaagtccaattaatccgtaacagctgtccaatctactttgttataataaacttagtcgcattagattatagaatagctcgcaataaaatctatacactcgaattgcatgacaattttcatcgtataaaatatgcacatatatcgcctctacttttgtatgaataaggccttttgacgacattttatacggaaactttgcacttacaaccatcgcataacgcggaaggagatttcgttatacaaactttctggttatctgggccatacattcggtgttcgaaaacttttgattatttttggcatcaacagattgagaagattcgcgtctacctgcgaaaagagtttttatgcaaatataccagaggtgcttcaaatttcaagaactttgttattgctttggaccttcccgacaatatttagcttcaagtgtataacagaaccaaatgctggttgttctattgtgattggatatatattattaagaaggaaatagttacagccttggtaggtctagtagatcattttaccgaaactttcggacgatttagcgttcctagaacatctaacgtccaagagaattgaattataggcaacgctcgactcacgttggctcatggaacatgtgcgttaaactgatgcaaattttgaagtttttgctcccctagcttgaacgatgtcaattatgatgaaaatgatcctcccaaaatttgaagtgattcggaagaaatttgactgtgcacacgccatttgaagtttatatggtgataactatggaaaacgccaatcttttgtgttcagccctctatctcttcgtcataatattttatggaaaagtgaacacactcatctcatgtgaatacttcccagctacaactttgctgaagactacattttgatgggacgttaggatattttttatttattgctaagaaagtctatatcatgctgatatggtcggggttctgctaaaccgcaccaaacgccatttttttctaaaatgagttatttacactagaggattcagattatcataacctatctacatttaagatatcgaataatttgaaccatccctcgttgagtaaattcaaaatttttctctagcaggatatgtaaaactgaaattgtatccaaccagagcgaaccataaaccttagcttgtcattggaagtaatttagaattctgattaaagacggcattttttttttaattcttccttaaatattgctaagtggccattcgggacaacatacagcaacaacgccaaaggattttagtatgtcatgtaagttaacggctttgtaaaatatagtattgtttcggtggtgctgatctaatatcattataattttgttcagccacaccgcaccaagtgccatttatataaaaatcgtgtttttgtatgaagaatagatatcaacatgcgcatgacgcttaccttcgctttatatataatatgtcgatgggttcatgcaggagccgtgatgaaataacaagacatttaaattggatgttatctgaataatttggaagcacttggtgcgaaaatgacgttttcacctattttcatcatcaagcctcctagatcagatcgcgcacagcttgtttcaagttattcgctctcaattcaacagttctaaatgaccgagaggtagcacgccttatcaccactcgaaggacatgagttcgaatcccgattaatatttttttacgttgtccctaacagggagttatataaaatcaatcaactttcagctcttatgactgttttgaacaataaagcacaagcagtttcatgtacaacgggaatgatgaaacgcatgccattcctggtatccacttcacataaaatttaataatcgtgaacttgttcagccaaagtgtattaaatgcgagtaacatgcatggcgatgatatgaaccctttttatttctttctttttcctgtgttcctggaaatcatgaaacacattcagccataccgaactgaaaaccattttcttcaatttttgttcagccagagtgaactgagtacctcttgatttgaaatcaaatcaaattaaatgaaaaataattgatgatttttttgaatattctatcttgagttacttcttggaccctatttgtcatttgtgaatggtgaaattttcaaaagagtcatttgcgatttacttgcagatgagtgaactttaaagttaaatatctcgaaataatgcttttggcacttggtgcggtttagcagaaccccgaccatatgatctttcaatcgcttcaatagcaacactgcttttttgctgtagaacatagcagcctggattactttgatctattcttcccgccaggagcaccactgttgcctgccatgctacatgcaaatcaactttatgatgataaataacaatttatcctgacgttcaatcaaaaagtggtcttcgacaaagttgtagctgggaagttttcacatgagatgagtgtgtttgctttttcataaaatattatgacgaagagatagagggctgaacacaaaatattctcaaactttaggaggatggtatatacgataattaaaaacgtttaagcataggggagctaaaatttcaaaatttgcataactctaatgtgcgtatatatctcatctataagaaaaccatgaaacctggtcgtgtaaatcgtttgctcataagtcttttgatttaatacaggtttgtccaacctttttgaaactcgggcacaatctcagttgttggagggccaaatattttgaagtctacaaagaaatcttttttaataaaatcaaacaaaagtcaatcaatagaaaagcttctcttctcgtcaagaattgaaaaaaaaaaatcaaacccttcgtttcattagaatgaaatcctagattttataagatacctgcctctaattctcagaattttacattgaaaaaaaaacaattgtgctaatggataacctgctctgctcttgttcacagttgatcaacagaagttttgtatggggaaaggcatctaacttcaaatatctcgtaaataaaagcttgaatcgtaaaaatatttgataggcgtgatagccaccatcactacgcataactggtaccaaatagttttttttttcgaaaatagttcccaatattgtgaaatattttccgagttgccttttagcgactttttgtgcatagacactagcgcatgtgcgttactgtgcgctgagtagcatatcagaccttgcatgtaacccattgattccgtcagaatgttgctaaagatttgctttgtaatcctgtcaaggaatctgtgaaattgctctctaggattgtatcagaatctcatctaggattatcttactgtcctcctcatgatattgtgagaataatgtttacgattaggaggatactgaaaatatcttgggagtaatcttttcaataatttagagaaccctgtcagaaattttgcttgaattcttcccagaactatgcaaaataatatgcgaatatgttagatcgatttgatctataacttttgttaaagtttgatggatatatagtatttttgtatcaagtagtgaaaaattatcttaactagaaatggactaaataaaccggagtcgttcaaaagaactgaaatgaacgagtgacccgtcggtctttttggcgagtacttgatcattcgatcagcagtcacacaacggatcagataaaaagtgacccgtgaaaagaatgatctgattcttttctcctattttcttttgttcgtatctcgactatattataacgcttgacacatgccttgctttgcgcgccatatcacacaggcaagcacagtttgctgctgctccgtgctctcagcaaagccagacaaatatgccccgcccacttgcattacaagcaaacgagagataaaaagagaaagtacccacctaaacggcgaatctctcatttgtttcggttagggaaaatcggccgattatcatgttcgtgtccggtcgaactgtgagtttatgaggaagaatgtacgaagaaaggaaggaaggaagcaaaagatcgtacagcacatggcgcacgagtcgtgcgacacggaatgaaccgttaaggcgaagtaggccgtcatttaaatttatacgcgtcgttcatgattgttgctaattcatctcacgatttcggatcaaagaaaatcagttggttttgcactgacccagctgaaaaagtatcagcatactttaagtatgttagcgcgtacagtgatactttttcaagtcaatataaactatcaagactgagttttatcgctttgaaatgcaagctgaaaagtcattattgttgccaaaacgaatgacgggctacttagccttaaatctgttcgcttggttcgctgagccattgaaccgaccaaaagatccgattcactaaagtgagtgattcgggtcggatccgttcaccagaaagagccgcctatctcttaacattacgaaatttaaacgtttacgaaaacataaacaatttttatgagcccattcaatcatgatattcggcgcttctgtataaaaaaaaactagtaacagattaattttcgacctaaaaccggactacaatgattatagaaatattttttccgccaattcctttcaatatttggccaaattttgtggctgccgaatattcgatacatcactggtaataaaaaaacagttctaacaataattcatactaagaaaaaaaattgcttaaatccattcacatattttcaaaatttgtgttgaggttcagcttgaaattatttacaaagaaataattttaactgacatgtacaaacttcaagcttaaagaacaatcgagcgccagatatgatataaatcttcaaactcttcgcaggccgcacaaaaggaatccgcgaggcgtacattgggcagccctggtctattacatcaattgattaaagcttcagtttgatttggagcacatcaaatatgttataacatatataacatgctgaaaatggtctcacataacatggttgaatattaaaaaaagatatgtcaaaaacaaaacagcactagtagatcatctgacctggactcccgaattatctgatgattatctgatgagcttaaatcgagtctaatacacgacactgtagacgacctttcagatgaagtcgaaatatgcgtatctgtcaaatgaagaaaaactctagtggaattaaatggtacagcactaaatacggttttaatttattttaactgtctcttgtatatgtgagtaagttaatcataacgcaaacaggaagattgaagtgcttactccgagactatttttttcatatattctggatatctgtctattcagttatatcaaaacttgtgtgtttaaattgttgcagtatagacactgaaggtacacctgtatcgcaaaaagtatgcgtctgtcttctgctcttgattttatactaataagccaaatagcacctgtgtatgctaatatagtgctattgaaaagctgacatgccctatataagtgtaaaatatcactatactacaaaaaaggcgtattcgcgggtaagtgattactttggcgactgaatatcgatcctagaagggttaatacgaggctaaggaaggcctcagtttcaaagtaccgtaggcaccacaaaaaaaaacaaatgaatattcctgatcatatataatgggaactaagactatttccaacgatcacactctcgcggggattgctgtacccatcccgatgatcttattccgatgggttcctttcccgcctgccatcatccattcgcgcgattaacgaaaacatgtgcattcaatgtaatatattttttgcgaacggccttttgttcatgtgattcatagtttatgtgcatatacaacattattatacggcgaaataataatgatgaacaaacaggcacacagacttcgactcgatagtctcagtcagtcagtcagcgttggttggttcgttgggtgggtagtgggttctgcgcgagttttcctacaataataataataagcaacaatgagcagccagccgtttggttgttggtggtttgacgacgacgatgacgacgggcggaatttaaatgctcgttctcgctggcttaatctcgcccctcttggtcttaaaccaccgtcagacggttggtcggtattcgtcatcgtcaacgtccaaatgcatggctggtagtgagacagttttatagactatactatatcactattttagataaggtcattaaaaagtcgctcttagcatacaaaaagtgactaaagcaagttttttttttcagaaattatggttactacggactctatgcccagggaagttaaagaaattaccttttacgaaaagatcctggtcctacccagacagatagattttcaagtttctatgcatttttttggactcacacttgtagttttgaaattactttttagtcactattctgatcatttcaattaggtgactaaacttcactactattttgcgataggtccgctaccagccctgcaaagcacccgtgacgacatacatcatcaatacgattatggactggacttggtagaaaaccgcacatagtaggagcacctagcagttgattcaccaaaaaaaaaaaactcttccaacaagaacagtagcagcatgtttgagccgatgctaaaaattggaatattatatatgggtgtttgaaaacacaacacaattattattaaatatgcgttccagcaggggttgcagcgccggcaatcagtaataaataataaccgaaggaaaattaacgcgcccggtctgcgccgggaaaaatggtgctgcagtggtggattgcacttttttggagcatgttgaaacaatagcgaaccgatcccggtagcaccgattaaattattctggttgggagattttccgcggttcccagcggaacttgatgtatgtaaattgcgttacaataataacttgcatttatgttcgattgtgtgtatggcttccgtgtgcattgatttcgggcagcaattttgtagcaagattttttttttgcaacattgttggatgcgatcgtaagaatcatgatcgagtgccgtaacaggttctgcgaggatctccgataacgattcttatattatcatagcaagtaaaacacaaatcgacttatcaatatacttaataagttgcctagttgcccattttcagtgcaatgtacagcaggttcatccttttcaaactgacttggacaataaatcgatggaaatgtaattgtaaagtttccaaaaatcaataaccaataatatgttatacggctttcactccaaatattatagaaatcgtttgtgatatgagtttcggataggttgccggtgccaatggttgtaatgtaccagtagattagacaatggaataaaatgtatatatttggataaaaacgacatgcgttatttttggtggatagataacttctacagtcaaacctccatgattcgatatctgaagggaccatcgactcatggaaatatcgagttatggaaacaaatgccttggaaagctgtttcaggggaccatcgaattaaccatgaaattttgttttcagtatggttccatgagtcgatatcgagctatggaacatcgactcatggaggtttaactgtagtttaatcgatttgcaagatttcggctttttgtgttaaaaaaaagtcatgtaaataattcgttttgcaaaaaaaaattgctcaattgtttcgtgtaagggcatgtctaggcctatcacggggctgctttgaggtgtattacgttttgcataaaagcttggaaaccatttttagcccatggtgggacaagtgttcgtattatcttgcggggaaaaatatgcaagttgcctaaaactcacatattacatttaaattaagcaaaatttgcctgatgatgcttggtttcagctttattgaatatatcatcactaaaagatggtaagaagatcgatcgaaagcacatgttatgtgaattgtaacaaaaattgttaccataagctgtactgtaaaactgtactcttaaaatttgattattttctatttgattgattgattctgttccttgtccacatgtgcactaattcattaacccaacaatcacagtggctttaggacatttggtcgaattacgtttgatcgaatgacatttgatcgaatgactttagaacatatcgccgagaggctgtttagtaatggttgatcgaaaaaccggttggttcaacagatataaaaccaaagattttttttacaattgatgatctttagtttattttgggcaaatatactttttatcagaagacagtaattaatctaactacatgataattgtgacctacagcgtagtagactgattcaaattttgaagtttttgctcccctatgtttaaacgatgtcaattatgatgaaaatcattctcccaatatatgaagtgatttggaagagatttggttgtgcacacgtcatttgaagtttatatggaaattactatggaaaagccaaaccttttgtgttcagtcctctatctgctcgtcataataatacatgaaaaagcgaacacactcttctcatgtaaaatcttcccagctacaactttgccgaagaccacattttgttgggacgtaaggataatttgttattcttgattccaaagtctaaactatgctgagatgatcattcaattactttcagagcaacactgcttttttgctgtagaacatagtagcctggattactttgatctattcttcccgccaggagcaccactgttgcctgccgaacagttggtgaagcatgttcaatgcaaacccactttatgatgatgaataacaattttttctgacgtccaatcaaaatgtggtcttcggcaaagttgtagctgaaagaatttcgcataaaaagagtgtgacagttctcacgtcaatcgtggcccaaaattcaggtataccatttcagctgacagcaatgcttgcagttttttatggccagtaataaatcgttaaacgaaagatttcacacaacgtagggtagaaaagcgagttagttgaaataaattttattcagttaaatccaaaccatcctcgagtgaagttccaagaattaaataaagtttaaagtagtcgtgaagtgcttgaaggttgagtgatcttgtggtgcccagttccggtagtgtctgaaacgtccgtgtgtgaccccaattccctgccggaagccacgatcctgccctaacagagtgtgttcacttttccgtaaaatatgatgacgaagagatagagggctgaacacaaaaggttggcgttttccatagtaatctccaaataaacttcaaatggcgtgtacacagtcaaatttcttccaaatcatttcaaattttgagaggatgctttttaccataatttaaatcgtttaagcataggggagcaaaaatttcgaaatttgcatcactctaacaacgtagtcagtatacatatgtactagtgtcaatgtagaatcaactagaatcaactaaaatgttcttatccttcagccatttctgaagacgggacgtttaatgtatgctatgtattgccaatcgttgaaaacataatgatctagggaatttattattcttttgaaataacatcattatttgtaaaaaaatcctccctaatgttttcgtcgctcagttattggaattttaaaccttcttaatttacaactattttttcaaaatgtcatcgatctcaatatgtaaaggctgatctttatccaattacaacttccagtaaacctatagtacctactaagttgacagtgtgactgtgagtaagaatttggaaagcgggaaccagacaattcggtaaccatgaactgtatgcatgtaatgcacttttatacgtatatttaattgtcaaattcgatggccatagtttttatgaaacgactttgacgaagttcatcgaaagttccgcctgtaaatatgatacattttcctattcatggtcaattactgtagtgatagtgactttcggctaaattacatcccttaagcaaacttgtggcttagttatcatggctgtttatcttgtataacgcgtgaaattagagtactcgacttaggttacaaaagcttacttgcttccattagagatcagctcgtcgcgattcattcgactcgcagaataagtcataaaatcgcatattgcaaactagaagattgttccaaaaatttcagtacatcaatgcagatgttttgcattccaacatgttgtcctagcaaaagcaacctccataccatggttagatatgagggtggtttaaaaaaattcgaatggatattaacgaaatggcagctatttgagaatgccttgtcggatgacgggtacgtaaaggtttatataaaaagttttgtaatcaatccacctagcagtgagatagaaacactagtttttcaaaacatttagatagacatatggtgtctgcggcaaagttgtagaagtggcaattttaaaacaactttgtcgaaaacaagatttttctatttcttatactttttgagatgtacgccgttgtatgtgaatgacccctaaacatcatatttttatagaaaaagttgtttccaagatttctaacaattttaagttttctgcaaagttatttgtcacttttttgatgaacatgtcatcacactatctcttgaaataacaatgttattcaaaatttactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgtttgtctatacgagtcttatcatacgttttcactatcaaccaaataggcctgatgaaaccgaaatcgacggataacttctttaccttaagagatagagagttgtgatgttcaacaaaaacacgcgttctaagatatgaacaactttgtaaaatacatgaaaaaagttaaaaatcttagtaaaaaggtatttacaaaaaatattttgaaagaagtttttttttcatacatatatgagcacatttgttaaaaacttcataacacttttaggagaattttgacatttttcatatgtgttataaagttgttcaatatcataaaacgcgtgtgtttgctgaatattgcaactttctatctctgaaggtggagatgaatcgaagccaaacctcaaattttcaaaagcacatatcttgagacccaaacaaccgattaagctaaaaacttaatcgattgttcactagctggtgatgaccaatcgattaaattttcagctcaaacgggtgttcggttctccagatttgtgctcttgaaaattcgaagtttggcttcacctaaaagtaaagaatcagtcgatttcggtttcataaggctcatttggttgaaagtaaaaacgcatgaatttttttttataggcgaaaattcttatcacctgccggaagagtagatatggtactttcgtaatatgtaagggttgtctgcgccattttgcgtgggaaacaggtattggggccttaactaccccttgaaaaaaaaagttatttttgaattactttgtaatttactaagataacgtgataacatgttcagcagaaatacggatttttagatgacaaacaactttgtaaaaaaaacatcaaaaatggtaaaaatcttggaaaaaaaattgataaaaaatattactacactttccaatgtcaagataagcaacatataagagtttaaaggtatttgctcgccttactagtaattttagtatttatttttgcaaaagtgaagtgttaaagtttaataagtagttttttctcttaaaaaaaatatacgttttagtggccattcacatacaacggtgttaatctcaaaaagtataagagataggaaaaatcatgtcttcgacaaagttgttccatattgccacttctacaatttttcactgctaggtgaattgatcaaaacactttttgaataaaaagatgccttttaatataccaaacaaactatcaactgtgacagagcctggttctcagctgttcttatcagcacttgtacagttgatgactaagttattatttctcgactagtgagattctaacctacgaccctcagcttggacttgcttaatagctacactgcggctttctggacccctgcttagtatgttggttctaagtccgcagatccagtgcataacacatattatagtcaatttgcaaagaaactgtgactgtagaagtgttctttgaacattaatctttgaagcagttttcacctctgtaaggacgtacgccagaaagaagaagaagaagacataacttcataatttctgtacgctgcaacattgtagtatcttagtacacagaaatacttgtttcctgtcgataatggctaatttctttccaatcagtaattttatgcttttcctttatttacgtcttacaatttatgttataaaaacatactttcccatcaacccctccactagcttcacataaaaagcagaattccttggtggattcaccaattcgaaagttcacccggagtctaggcccatgtcgcggtttcacgcttctgcaacggagaacatgtcggatccataacacgataaaaagaaacattaacactctttgacgtcggctttcgacttaaacatcaatggttgcaatgccccttgctcttcccttatgattcccttccgctcatcatacaactactctaaaatattatatattaatacaacattatgggtcaaggaattttccattacgaattgatcatgaaccgaccagcaatcgatcctagacgccttcagaatggatttgctttttggacgtgaatgttaccactagaatacggaaggccccagtaatttctaattgaaactgagacaaagtgaccgacagtaactgtttagaaatttgcacaaataagtaaatctataaacaattcatacgcagaacagctaagtcaatttcccttgaaacggttacaatcaatgattgaaacattggataaaataaaaacatgagataaaataaaaacaacggcaaaaaatggaaataatttcaattattactaaattttcacaaactacatcaaccctcaactgaatcgaaagaatgttacgatggcagacatgtgtttcgttttttgagaggtgcgggaatctgtagtgagacttttttcgatcagttttcattatgggacacttcgactaaatagttttactcaattactaacttaatttgtttcaattataacaaaaatataccgtaaccggatgtcaaatatagtcagtatgtaaaaagcgcgatggattacttttaatctataaataatttggttgccaaaataactgaagcagtaacgcgcaactcatcaacaagatcatgctgagtgccaaagtaaccactagcccgcttattcaccgttttggacttataggctattccagggcatattatatcttcgtggctttgatatcgtatttagattcagaaatggtcaattggcatagaaagctttaagttgataactgtggaagtgcacaatagaacactaagctgaaaagcaggatttgtcccaattcggccttaacttaagaaaatagaagaagaaaagaaagtgctcattgaacattaatctttgaagcatgttttgtctcagtaggggcgtccatcagaaaaatgaagaagaagaagaagatatacataacttcattacctctgtacgctgcaacaaagtaataacttagacacaaaaatacttgtttcctgtcaataatggctaatttttttccaatcactaaattcatgcttttcccccataaacatctcacaatttatgttataaaaacacacgctctctctctccctgcctcccttggcggattcatcatttcggaaattcgccccacagtctaggaaggaaccccggccggcccgagtcgcggtttcacgcttctacaacagtgaactccggtgtcggatccataacacgataaaaagaaatatcaacactctggcgcgtcgggtcaaatgaggcgttttttgcattcgcgagaccgtcacaccgaatggttgcaatgccccgagccctcaccccccatttcagcgcgggagcacattaaaagatgcgagagcataaagaggtacaaaactcctttcggggtcggctgcacttttgcagtatgcatatcgtaataaaatgcgtttaatatgggcccaggttggtcagcagggtatcacccatcgcacaccaccaccagcgtcatcgtcgtcgtcgctagagaattgcactgggaaggggaatgaggatgtggaaggccagaaaaaaagtgctacatcgtgtacatacttcaataagagcagcacttttattgaattcagcaaagcaaagcgaaaaaattatgctcatgtacatcattcagataacgttggatgcgtacagggtgcgctggtaaaagttataagaatcatgtgttttggacttttagaagttatctgaaggttcaaggtatcagaggtttctgatagatctagtgagagtcgagtaaccagctcgaaggtcttcttcttctttttgacattacgttcagtattctgaagtcttttgactggtttcttcttcttcttcttggcattacgttctcactagaacaaagcctgcttcttggttaagtgagcacttccacaattatttactgagagctttctttgccaaagttgccattttcgcattcgtatatcgtgtggcaggtacgatggtactctatgtccaggaaattcagggaaatttccattacgaaaagatcttggaccgaacaggaatcgagaccggacaccttcagcatggctttgctttgtaaccgccgactctaaccactcggctaaggaaggcatccgtaaagctgttcatagtaactatgatttttagcttttagtatggttccatgaggcggaaccgagtaatggaacatcgactcatgtattttgatacacatttttcggtacgacgtagacattacttcagagatgtctcgaaattcttggaggcaacccttcaagtattcctccaaaaaatttctttgaaatgtttcaagcattccagattcaaagagtttatttggctatcattgcagaaattcttcaaaaacttcgttgggtgtctttcaagatttcatccaggtatccctcgagggaaaccttcatggatttctagaaattctaatccgtaatttacattgattgtgctataaatttcctaggagattctccaattacttatttaggtattccaccaactccttcctgaatttattgttgagttcttcctggaatcctccctgaagtcctactgtttcaccagtgattcatacaattaatcattcacattatcttgcagacttttatttgataaatttttgcagcattaaagctttcttctagttaattcagtaattctttcaagatttcaccaatgttcaacgaattttgtagagtgctttcaatcttccaatcttggatgatttcattttaatacttcagaaattaaaacttctatgattttctcctgtaacttctccaggcatttttctgggttgatcatttgtatttgtgttgagttcattgtccatgttttcattaagattattataagcaaaaacgcgacaaaaaacgtttttggccgtttttcgttcttctaaagactttttcttggtatattaaagtcatcatctccatctggggatttcttttggaacgcttttagatttgtgaatgaatagtagactgcttcaagaataccccaggaattacttcatgtattaagaccagaatttcaccagagattaaaacgatttcttcaaaaaatacagcatatttttatattccgtattttactgaagtgttctactgattcagctgagaatttctccatggacacataggaaatatcctcaaaaaaaaaaaagacttattgcaatacttattcctgtagtacttcaaaaagtactcaacgggttttacttaaaacttgcttcatgattttctcaaaatattgtgagagtgtttctttgaagagttgctagataattccatacaggaagccgttacggaatcttttcatatacttccgtaataatacaagaaaggttcggtaaagcatatcttttggaatccttgatgagatttttgcaagactacctgaaacttataatcaaagtattcttgaagaatctcgtggaaaagcctcatagaaaatttcaaaagaagtcctaatagagtttctagtaaacttgctattagacattcctgaagtaatccttgaataaaactatgggagaatgcatggaaaaattactttcaagaaacagtgggtatattccttgtagacttctattgaaattgtctagcaggatgtcaacttggcgtactctacacgtttgcttcataaatgaatgctggattcacggcccccgataaaaatgtcgacaggaggcttaagaaaagagttcacctgcccaacatattcgccttctgaaagcggatcctcctctaatcataccagctcaaatgtatcagaatagcataaaaatctttattggttgaaaaagcaacatcacgtgctcaaaaacatgaaaaaatcatttttttacattatttaagtgttttcgccggaaattacagttttaccataaaatcaaagtttacaaaacatcttgttctgaatacgtcttgcatagtgcatgtattttaaactcatgcaataatatttttgatacaaaagaggtttttttttattatcgtacaaattgggccgaagggtctcagattttcatgaaactttttccacaggcagggctcatggatatatgaataaaaaaaaaattgagaaaaattcagggtcgcctatttttccggaaaactcaggtggaatttttttgttttcccttgacactacttactttgaaaaatcataactcaagaacgaagcatcgtagaaacaaagtttttatatgaaaatttaagcaaattttctgaaaaatccaaaaaaaatatgaagtggaaaaagtttcccacaaaattttccaccgttgggaaaattcgtaaagaatagccggaaaaactatgcccgaacttgtggaaaattttcaaaaaaatattttcgagaaggtaattttataagctttaatcactgaaatttttggaatgcacttttttttcgtttttgagttatggccaattttgtgaaaaatgtccagatgtgccatataagacttttctttgaaaaatcataactcaagaacgaaacattgtagacacaaagttttatatgaaaatttaagcaaattttcacagaaatcaaaaaaaaattgaactggataaagttttccacaaaattttccaccgttagggaaattaataaagaaaagctggaaaatctatgcccgaactcgcggaaatttttaattaaaatatttttgagaaggaaagtttataaacttcaattctagtaacttttaggatgtacttttttttgttcctgagttatggtcaattttgtgaaaaatgaccatattagccttttctttgaaagcaaatctttgcatttttctccaaattgatcatagatcaggaactaaagaaaagtacatccttaaagttaccagaattgaagtttataaagtttctttcttaaaactattttatttaaaaattttccaacggtggaaaattttgtggaaaactttttccagttcatatttttttttggatttttgagaaaatttgcttaaattttcatataaaaactttgtttctacgatgcttcgttcttgagttatgattttttaaagtaagtagtgtcaagggaaaacaaaaaatttccacctgagttttccggaaaaataggcgaccctgaatttttctcattttttttattcatatatccatgagccctgcctgtggaaaaagtttcatgaaaatctgagacccttcggcccaaacccgtacggtaataaaaaaaaatccccaaaactattacaacgacctttccaaaggtataacaaatgagaaaaactaacttcaaaggtaacgtttaagaggcaaaaacttgagaaatttggcatttttcgttaaaaatcaagtttttgtgcagtttttgtaaaaaaaactagctaattttttttagtgtaatgtgttgcatgcacagttttacaacaacttaatttacttcaaaaacatattagaagaattagaatcgattgaatattcataaagttatggtcacaaagttgcttttttcaaagtaaaatgaggaaaaatttggagtaaactgcttgttttgattttagacaaatttggtgttctacaaagttttcataaattgattttatatttatgtatataatattatatttattatattttatttttaattcatattgatgccaaaagttttgaaattggttttgaaaaagttttggtaacttctttgaagtttctttttataacttgaaagttcactttaaagtcgccggcgtcacctctaaatgttaatatttgtggctcaaatttaaaggcttatctttgtatacgattcaaattcagaagagcacacgaaattttgatttttaaaacttttgaaaaataggctgcaccctaatgctcatcgatctactggtgaaagtaaagattgcaaaaaggaaaagacaagtcaaggaatagcttatccggtctctctgcaaaagcacagcagttaaatcgatccacgctctcatgatgttgaatagagctaaagcgcaagtagttaaggaaaaaaggtagcaagagcatgtaaaaacatctttgccagagttttttttttagttttttgaggaattgaattccaaattgaaatttggaaggattcccgactattaccatgaagagtcctaagatgaatctctagtgtaataattggagcaattcgtgaaaaaagcccttaagaaatttgttgataaattccttctctgaatgaatggcggaattccaggtgcgattaacaggagaacttatgtcttatagatgaaattttgagtaattattggaatgatacctgtaagaatttctaaatgaaatccccgcgagaatttctgggaacttgaggcagtaatccagtttttttaacagttttcttttagccatcctcgaaataattattgggggaattcttggagaaatatttgaaatattttggagagaaattcccaaagaaatttgtggagaaattccgacaaaaatctcggaaaaagatatgggagtattccttggatgtatgcacagaggaatttatgaaaataattaccgttggtatcccttgaaaaattcttcaaaaagaaattatccatcattctttcacaaattttccagtttttttttttgctcaaaatttaagaaatattcaagaaaatctatcattggattgcacttgctatctgtaaggtgatgattgattttcatgaggatttttttttagtctggaacgaaaaactgattttttatttttgatgattgatgatcattgaagtgagccttaaagtgcccggataaagttgtagaattatttgtaaaataattcgtggaaaaatttctgacaaaagctctcgactcttagaattcttggaacaattcttaaagcaatcttctgaaaaattcttggaaaaaatcttggtgcaatctcaaaagaaattcctgtcgtttgatagcgataaagaattcttgaatatagtaaaattctagaaggagccattggagaaatctttgaagatacagcgtgactcctttctgaaaaagttcctgaagacattcatgaacaattatcttttggaatctatgaagattttctagttagattccttcctgaactttccaagtaatcaaatagcactttaattcaacctgcgtgccaatgtagtgctataatagtgctgacatgccctatattagctgtataatagcccagtgagcccaagtaggtggataagcgtccgaccatttattagatttattacgtttagtatcatataggtttacctgcagtggtcggtttctcttcgtcgattttctctatggattagtactcaaaattcaatcgagttttcggaacattttataatgtagcatgacgaacgacaatgaatagcatcagttgaatcgaaaaatagcagtcaaaacagttgcccggccaaattattagctaaagagcaagacgctgaagagaaatcaattattgcagttacgcccttataatactgaacgccagatttattgttatatcatccgtgtcctaagtaaagcgaacgtcacattgttcagtagtcatcaggaggcaacacagcggatttcagtctcaacggcaatcagaactacaagatttcttctacgctcaacgtttcgattgtattttcaatctttttcaagggtgctaaaggacaaattagacttcgtttcaggcaaaaatttaaaaacaactaaaagaacagaaaaattttgttctttttcttgtagccatttttcatagatcggggtcaagatattggtgtacatcaatttccgaaaaaaatttcaataaacagacacgttatacaattcaaatttttcaatactgaagacattaattaactgtgtgtaacgaagtccaatttgtccttgaaaaagattagaaatacaatcaaaacatagaaaaaaaattgtagttctgattgttgttaagactgaaagcagtaaggaaaacccccggtgcaacttacaacaaacgaaagcacccaactagaacgtaattaaataagtgaaaataatttcgctgttggattgtgagaaatttcaaccgaccagtattttaaatacgaactagacctgtaatcccagatcatatttcgtcgtctgttgcttgtagcaaacgggatcaagggaagtccttcaagacccttttaaatgtcgcatctccttcttatcggtttcaaaaagacatattgtattgtgtggagttgtggatgtcaaatcatgtaaaagatacagcatccattcattatataaggccacgattggaaatttttaatccccttttccccttgcgtaacgatgagaaatttcaaaatattctatgggtcacaacgttagagcccaacgttttctcgagcgttatgtaacttgtgaattgtaccagggactacgacaagatgatggaccaccgtgcgctagacggttttatgcggaaagccgggttcaatagtcgatgaatgattttcaacagattcagtcaatttgattgcttcggagattgtatgggcttgctaggaagcggagccgagcgcgacaagaaaacagtgtcatgatagaaggggatacggccaatgagcttgtctgtcttagatgcttgctgtcggctgatcgtaacattaatcgtgcggtggcatatggtttgttgttgatgtaggattggcttttcagtcctgacaaaattcaaaactgttattttattttgtccaacgttttggtccgtttgggactttccaccagactttgacagggtctaccaaaccacaaaagaactgtaacaattaagtccctgaagaaggtcctacacggactgaaacgttggacaaaataaaataacggttttgaattttgtcaagactgaaaagccaatccaacatcaacaagaaactacagtcaaacaaccaacgatgatatcgtttgtcaggcatactacgtgctgcagaagaagccgcgatcaaataagtttcacttctgaacctaatatccaaaatgctcctaagatcgatagtccttaatagctttcctcgagaaggaccttcaaaaacctgcattttggaacgcgcaatgcttaggatcatatttggggcttgaagatccataagtggtggcgaaagacaaagcacaaactcgtccaacgctacggcgaacctagtgtccagaaggtgacaaaagctggaaggatacgatgggtagagcatgttgcaagaataccagagagcattcctacacgaggctcgaacacgccatcttcaatatgtttatgctgagaagctgcgcatttctcgctacggtcctaagctgctatgtaccaaacacggttaaacttttaaaaatagtatggaacgcgctcagcatgagtattgaaagagtgttaaaactaatgctctttttcagtttttgaagccggaaattttcattttgaaacaaacaagaaaatatggatttactgatttttaactgctttcatttctaacaagaaacgtttcatttaaatggctaatgaagccattttttccaagcccacactgtccacgcagacagttgaatgaaaaactcgcttcacttactcactctcacacggtcagtaagtacaccataccggacaccaacagaaggagtatggaagggggtggatggcgaggatcaaaaacacaatgtgcctgttagcattgctgtacttttcattacaaattatcccttcatgtagaaaagagttgaagctgctgttgctgctgcagttggttgatatttgcagggtggagaaaaaaaacgacagaaccgaatcaacagcccacaggtagcgacggagatttcaacgcgatgagtgatttttcatgacttctgcgagacgacgacgccgaagacgatgacgagagtgatgagctctagcagctaggggtatgcgataatttatagttgtttagtagaatacctataagtaaatggaaatcggattcagtgctataccattgagttccactagagtttgtatccttcgacagatacgtgtatttcgacctcaactgtaagaaatctgtcgtacgaagtccctgttttgtagaaacctaaattttaagagttattaggtacttcacgggaacgatttgaaggtattaagttgaaaagccatgtattaacattgctttggtgtctgttgagttgcgttgtaggtacctgttgcagactttcagccaaatacaattttcaaggtgaagaaacttttctcaaaatgtttatatctgttaagacaagttctgctaccttagatttgaatcgtgagtcatcctcttgtatatcgtcttctgcgcgtttcctatttcggcaaagtgttccttgaatctgccatcgatagactgctttgtttgaccaacgtagaccttgctgcagtgaggacaactgattttataaacaccagccttgttcagtgtgtttaccggatccttggtagagcccaacagaatcttgagttggtagtctctactgaaaaacaccaaatcgattccgaaaatcactagatttgggcggagttgatgtgccagtcataagggatggagactatcttcgtggattctgcgatttatttatacatatttatatcgcatacccttcccatcaactaggaggccgattgaatagttgtgtgagagggtttctgttggcaggggggcccttaatgcgaaactatgctccgcgaagattggctgcggtaggaaacaggcagccagccagccagcattgatggctatggatgtggatgatgataaccctgcgaaatttgcccgaggctacgagagtgtgcattatttatgcaactgaactcgatggctgctgctgctagacgatttttaagttgcttttcacaggaatgttggactacggttttatgagatggaaatggtttatggtgcattgacgaagatgatgatgatggtgagcatgctccgagaaattagcgagacgtgcgatgttttagggctcctctgcggaattaacatgattattaggagattttgattacaagctccgtctaatgataatgggagtgagaagcattaaacatgaatttgttatggattttttttcgatgattgtttatgttgaaaacttgagaaaagccaataaaaatgtttgcaacaatgtgtagctccataatccaattaagaggaatgggcaatgaagttgttgtttcatgacagcggatgaaggcataatccaacatttttttccacatcaaactgacagccaactgcctcactcaacataggtgccaaataattactttattttcacacatcgttttcttaccccgtattaagctcattttaattacccaattgtacttcatccctcactcaacgtcatcggagcgcctgaaatgccataaaattatgtttaattgtcccacgtctacgaattacagttaacaattcgatgaacaagtcaaacaacgttttgaacttggcattcctcgttaattccgcattcaccggcgtcgtccttcccttatgacagaatgattaaacgcacttagcccgttcaccacatgacaaaacatttaattccgcgcgatctttcaaatgaccctcgggggcaggtgcagtcgcatttcgagtgcagctttttttctttttttttttttgctttcaactggaccccatcggcaatggtcataattgcaaaacggtagcatcagatatcagatcgagaaattcctcgcaaacaaaatgccatatcatcaatgcaaatactctcgcttttttcgttttcttgctgcgagatcgcgcattgcaaagtggttcggtggcagccaaaacgtataaaaatggattaatatcctccttcggagggtaatatttttctcggtcaacatttgaacatctccatcaaacatttcctcagcacctacctctagctctacctgcaaccatgtacatacttagttttagttgaatgaatgatcaggccaatcctctcagtctccctcttcagcggcacgaaggcctcctccactaacctgcgatcgattccagtaagggatggtacacaaattatgtcacgttaaatttcaacttttgtgactcccccccccccattgtcacggtttttgcacgagtcctccgattttataaagctcatcacgcttggcttgacccctcccccctggagcgtgacataatttgtgcatgacccctaaggtcgattgccaaccgtttgataatagtgccgtttctctgcacgccagatctcctgatagcaccctcgagtgcaatgttgaacagttaattcgaaagtgcgtctccctgcttcaatccgtctaatgttttgatcgagactgacacctcctatgcaatctgagcaaatgatttcgacccatccagcgcagtacgtatcagcctaactagtttcgccggaaaaccatgttcagaaactatctgccacagctcatttgttaccactgaatcgtaccagcttggtattcgccgacaaaggactcctagagcggcctcagcctgttgaacaagatgcccaacagtattttgtacgccgaatccagcaggttaattcctcacactccagtctgtgtactttcttgtaaattggacgtatcaggccatccttgggtccttagaattatttggagaaatttcaaaaggaattctaagatgaatctctaatggaaattttgaagaaatctcaagaggaattatgtaagaaatgtcttggaggaattgttgaagagaattctcgaaaacttcttgaaaacaacgagtagaaataactataaaacctctcaggaattcctggaatgatccataggggaaaatcttgaagaaatatcaccatggacaagtttatgtgaatttttttggatgtatttctggagaaatttcagaaatgaaatacctgacatttttggagaaaataagtgatagattttcctgtaatatatataaggaatacctagaataatttctagaagaatctctggacaaatttctggaaaaattaaatgaagaaatcatgcagaaatctatgagggatttcgagagaattcgctgagtgatctaagaacaattactgcaataacttctataaaaatgcctagaaaatctaaattgatggcaattgaaatttgaaatccctggaagaatttctgaaagaacacaaaagaaatgtttgaagtaatacttgaaggaaccacgggaggaattcctgtataaaatacatgaggatccttggtgaaatttctgaaaaaatcataaaatattctttggaaaaatctgtagaaggtccttgcgtaacctctcgaggaataacttaaggaatatcaggagagcatttttgagaaatcccaggagacatctctggagagctttctgtaagaaaacagggcgaaatatttgaaaaatccctggatgtatttgttaagaaactctagtatgaatttctttataaatctcttatgctatccttaattcctctggggggcaggcaaaaccaatggttgaattcctggaggaacttctcctgaaattcttgtttgaatacctgaagaatttcaaacgaatatctggtgaaattcttggaggaatccctggtgaaatttctgaagaaacctccgatggcaaaattaacacagaatatccagggttccattctaggatttcatggctttcatttaaagtaaaaaaaaaaaaacgtttcaaaactggattttaagagcattttaaagtaattggcaattttggaccattaatgtataatgcagcccacagatgactcagatcgtttgaccaacattgactctgcccatagattgtttgatgaactactgatcctattgtctgtagggatgttgcaagaaaatcgacgtccgcatgtcaaattttaagctccggcaaatccatcagcagtttacctgcgattacatcaacatatcaaaaatgaattctatcctggattgtatctacaacatagtttcccaaactgtgggtcgcgaccccttggggggtcgtgagtcagtctttggtgggtcgcgaaaaaatttcaaagtaatttattttctatgtttacttagactttggccactgtttgaaaattattcatcatattgttactttataacaaaaaaagtttcttccagttcggccagttggcactattgatacctttctaaggttaagatctaagactgaaacatttgaatagttattaaagaaagggtcgtcgacaatagcatcacatacagctttctttagtcgttctttcttaataaaccatacttattctgcaatcgagcttccatgaatcgaagagattattgacccatggaaatatcgagtaatgtaacaattatttttgggaaagctgtttgagatgaacattatagcaataatttttttttatattttccgtatggttcacggtatcaaaatcttcattattatcaatcctgcatgtttctccaatatttccacgaaaacgtttagcatttggtctaagattttgtggttggaaggataaaaaatattcggtcggagaaaatttcccttgcattttgtatgcaacaattttaactgcaaaattgtcttttcttgggttaagtttgtaaaataatatatggaattttgatagatgtcgagacattaaaacaattcttagtgttgttacaagggttacaagtacaaaagaaaaataaatgatttttattcactgttgtattaatcaaacatagtacatgttaatgtcaattacgccttgtgatcaaatcccattcccaataaaataataagtgacctcagaagcttcagtacaaaacttgtctctaaataatttttcactggtgggtcgcaaggaatgcgcttgttggctaggtgggccgcgcaaccaaaaagtttgggaacctatgatctacaataaagtcatcagcaatttcatcaggaatttctcctgctgcagcaattaatttaggaactctaccaaaattccttcatcaataatttcttcaatatcccaccaagagttctttaagaaattcaatcaagattttgtccagtgattcaaccaggaatttctgaaaagatttcgtcagcacttccatccggaagttcagtgggaattggtcgcgaagtatcatcaggagttcctaaagggctgttcaagagattcagaaattccatcaggagaactcccgtcataagttactgtaaggattccgccaggaattccttcagaaattccactaggaactccatcaaaatttcctccagggatttcatcagtagttcctacagggattccatcagttgttcctctagggatcaggagttattgtagggatttacacaccagtccgtctaggaattttaccaattttctatcaggagtacccttagggtttccattagagtacctatgggtatttcatcaggatttcatcaggagtccatccagggattacatctagagatttttcagactttctacctggaattcctccagaatatctttggaatacctcgagaaattccacaaggatttattatccaacagaaattttaacaggaattcctccagagatttcatcaggagtttctcctatgattctatcaggagttcattcagggatcccatctgaaattcctccagggattctatcgggaattccatcagggattccacctgataatcttctaaggatttcatcaggagttccttcactgattctatcaagagctgcttcagaaattccacctggaattcctcaagttattctatcaggagttattcgggaaattccatcaggatttctgttaggaatatcaaaaggagttcctctaggtattctatcaggagttccatcaggaatctcatcaggaattccttcagggatttcatcaggaatttctataggaattccatcaggaattcttctacggattatatcaggagttccttcaagaatatctttaggaattcctccaaagattccatcagcagtttatccagcgatttcatcaggagaacctataggggttccattaggacttccatcagagttcttctggggattttgtcagaattccctacgaggattctatcatgagcttcttcagagattccacctggatttcctctagattttctatcagaagttcagaggatcagaggattccatcaggatttcataaggagttcctctagcaaccctatcaagagttcctttaaaaatattcagtcggagtctttacctggaatacctccaggaattctgtccggcgtttctccagggattccatcaggagttcttccaataatccaatcaggagttacttcagggattccacctggtatgcctccagagattctatcgggagttccatcacgagtttcttaaggaattccatcaggatttcttctagggatatcataaggagttcctctaggtattctaggaggagtcccatcaagaatctaatcaggaattcctccatggatttcatcaggaattcctaataatatctttaggaattccttcaaggattctatcaacagtttccagggattccatcagaagtaccttaaggacttccatccgagttcttttgggaatttcatcactgattctatcatgagcttcttcaaagattctacctggaattcctatagatgttctatcaggaaatcctccacaaattatacctcgaggattccatcaggagttccatcagaaatctcatcacgaattccttcagggatttcatcaggagttcctatagggattccattaggaatctcatgagtcccttcaagaacctaatcagaaattccttcatggatttcatcgggagtttctatcagggttccatcaggaattcttctagggatttcctccaatggttccatcagaaattctttcaaaaatatctttaggattgcctccaaggattctatcaacagtttctccagggattccatcaggagtacctttaggacttccatcagagttcttctgggaattttatcaggagttccttcactgattccttcaagagctacttcagaaattccacctggaattcctctagatattctatcaggagttcctccagagattgattcaagagttcctccagagattgtatcaagcgttcctcgggaaattccatcaggatttatgctaaaaatatcaaaaggagttcctccaggtattctattaaaagtttcatcagcaatctcatcagtttcttcaggaaggatcaggagttccttcaagaatatctttaggaattcctccaaagattatttcaggagattctccagggatttcatcaggactacttttagcacttccatcagagttcttctggggatttcatcaggattctatcaagagcgattccacctggaatacttccagatattctatcaggagttcctgcagatattatatcaggagttcttcagggatttcatcaggatttctgctagcgatatcataaagagatcctcaaggtattctgtcagaagttccatcaggagttcctaaagggaacttattaagagttttctagagatttcatcagaagttcctgcagggattccacctggaattcctccacatattctaacaagagagggatttctgtttgggatataattaagagtttctctaggttttctattaggagttccatcatgaatcttatcaggaattccgtcagggattttatcaggagttccttaaaatatatcattaggaattgctccaaggattctatcaggattttctccagggatttcatcaggagtacctttagggcttccatcagagttcttctggggatttcatcaggatttcctccactgtttctcccaagagcttcttcagagattgtacctggaactcctgcagataatctatcaggatttcctcgaggaataccatcaggatgtctgctagggatatcataagcagttcctctagcgattccaagactagttctatcgaaaatcttatcaggaaatcctccagggatttcatcaggagttcctacaaggagcccttcaaaagttcctctagagattccatcagaatttcctgcagagattctacctggattttttccaaagattatatcaggagtttctcaagtaaatagatcaggatttttttttgggatttcatctccagggattccatcaggaattacttcagaattcatatcagtaatatcttcagaaatttcaacaggagtttctataaagattccattgggagttcctcaagagattccgtcagaagtttcttcagggatttcataaggttttccttcagagattttacctggaatatatccagagattctattaggagttcctttaggtattctatcagaagttctatcaggaatcttatcaagcatttctccagggatttaatcatgagttcccctagggatttcttcaggaattcttgtagggatttcatcaggaattcctccaatgattccatcaggagttccttcaagaatatcttaaggaattcctccaaggattctatcaagagtttctccagggattccatcaggactacctttagggctttcatcagagttcttctgggaatttcatcgggattccctccagggatgcttcttcttctttctggcgttacgtccccactgggacagagcctgcttctcagcttagtgttcttatgagcactttcacagttattaactgagagcttactatgccaatgaccatttttgcatgtgtatatcgtgtggcaggtacgaagatactctatgccctgggaagtcgagaaaatttccaacccgaaaagatcctcgaccagtgggattcgaacccacgaccctcagcttggtcttgctgaatagctgcgcgtttaccgctacggctatctgggccccatgatgctatcaagagcttatttgaagattctacctggaattcctccagatattctatcaggagttcctttagggaatatatcaggaattccatcaggatttctgctacggctatcatatggagttcctcttgcgattctatcaagagttcaattgaaaatcttatcaggagttcctccagggactccattagagttcttacaaggataacatcagaagttccttgaagtattgcaactggagttcctccagggtttccatcaaaagttccttcagagattaccttgaaataaaatcccggaggaatctaaagaaaaaatactagtaagaatcgctgcagaaacttcttaggcggcatccacaaattacgtaacgctctagggggaggggggagttggctcaagcgttacggctcatacaaaaattttaaatttttcatacacaaaaacctaacgaaggggggggggtcaaaaatttccaattttagcgttacgtaataaatggacgctgccttagcagaatttcttgtgggactcttggtggaatttagggaggaatcctaggagaaagccctgaaaaaatcctagggtaatttctggtaatgaatttcttgaaaaaatccttgagaagtttatgaaaggattcatgatgcgattcctgggtgatgcgttatggaatccttggaacttacctctagaggaatttctgaagaaatatttgaagagatagttatagaaatcttaggaggaattcttggaggcagccttggagtaaaacctgaagaattactgaaaaaatcacatgaggatacttttggattgatctttgtaggaatcggcaaaggaaattctgaaaaaaatgtagtggaacatttgtatgaatttctggaagaatgtcaggcatacgcctgatgcattttcctcggaggattttctagctgaatctgtggataaatttctagaggaatggttgataaaactcctggtattaatctctagtataacccatggatgcttctaaaaactccaaagtagaataactagaggaaaccacttaaagattctgaatagagtgtttaagaaattcccatagccttcgggtgcattttttaatccccgacatagatccctaataattttgaagtcttgcctgaacacttcgtgcgaattataactggtattcctcaccagtatccatttcctccggtacttaaatttggatggttcttctcttcctgctcttctttactacaactattgctcgaaaatagtagaaatatccccccacagccacagaatgcgaaaatataacaatcatttatccactagacttgccaagataattcaaaacatgcgaagaaaactagtgtttatgcaacgatttttgacagtcggtcaaacggttgcattagaataagcattaagcatttcgcacaaattcgcacatacactcctgattagaacaaactcaccaaattcgtctttcgaagctcctctgtaatccgccgctattctcaaagtgggatccaaacacttccgcagttgtccattcagctgatcgaagtcgatgtatgcctttttatcttttccacaatattttatttaaaagcgatctaaacacttgaaaaacagataggaaaaaaggctgatattctcaccgtccaaactagaaaaaatagaaaaaataggagccgagatgaaacgtggcagcaaaatcaaaacacgtccactcgcgcgcacagcctactcagctcctcagtcggtcaaacggatgcatcaacataaatcggttcggactaaccttggaagcggagtcaatgttggtcagaccgtctcagcatatgtgtgctgcaaaaggtggtactttttattagcatagactcattgtacatgtcaatgatttttattgtgtgatggtcggaactggtaaggattgcacttcgatccaaaggaatcagggttgggactttttgcttatctttaacgtgcacattttgttagaatcattttattgatcaatttattgaacaataactgcgttgtcatagtccttacagtcaattggtatggggaaggaatgttagggtgtaatgattgttgatttcagagacctagaatacctctgcatctccacaaacaccacgaaaagggtgttcataagtgagggaggaataagatctggtagtcacctttggtgatgcgatccatgcataagagggaagtatacgactcttacatataactagtgttgcatttttgccttgaggtggaaaaacattgacagaagattaaaaaatgcgctgacgttcataattccttgatatattcaaaggttattagtaatgacgataaaagatggaatagatacaaatttgttattataatcatgaaacgagctcaccagttggtaatctatccatgactgaagacaaattcacactcgcgcaacgctttttctcaatgcattacgatagtaaaatcaaattgaaacagtgttaaccatttatttgacagttaggcgtttcggtcaacatttgttcttgcatcgaacccccgtgcaacggtgctaccgaaccatattttcccatttctggagcgcttgtaacgccccatcccaggcaattatgcagtgggaaaacaagtcgtcaaaccgcttatgccctctggagcagcgcgttgcctgaacgtttaccgcgcgcagcacaattcgcatacatttcataattccatttcattttacatttcaattctcgttctgtgtctgtggcttcgtgtcgtgctctcggactgggagatgccattatggatggtgtttgaggcggcggcatggagatacgcgatcgtgatcggtgtccgtctccgataatcatcagcaagagtcatgtagtgttgctgcccacctaaccattccagtccagcaatggacccgacgaaaacaaccgcccgcgggattctgattgaattgcgaatcgaatgatgatttgaatgctcgcgagattcgattcgtcggtggcagcgaaccttttgcggtgtgggcagaaatcgggtgcattttgaacgcccagaaaacctaatcgtacctgcgccctcgttcttcgatgggttattccggagggcacacggtgtgtctgaaaccgctattgacgaaaaaaaaactctgaaattttcggagatggagctcgatcactatttattttaagtgctggatgccaaatttgtgtacatttattttcggtaacaatggttccagccacaccgtttcctctaatcggttttgtgatggccgatgaaggttgaattgccttctttcttctgaataaatctcgaaaacaaaactaattgccgcccgagtcaattgttgccgctgccgtctatcgcgcgcggttcattataataaatcagtcaatcttcggagttcggaggcgcttcttcggaatcattgattatcccgttcgggccactttccacctcacctcactcatacccatagctccttttaattacattcgaaatctttcagaaattaagcggaactaatggttaaattcgaaacgaagatttcaatcagcaatattattaccattgggatttatctgctgtctggtggtagtttcacctttgtactccggctgctgatggttatttacaaatgaacattcattacaatgtgtagagagttgccaacggaaagccattaatcatatttgctgctttgcttcggagcacaaaccttcggaagccaatcggcacacatgagatgcgatgctgccaaacagttaggagtcagtcagttttagagagaccccggcctttccgagcagaaacattgtgtggccagtgccagtcgaccttccctctccggcgaaacaaaacaaagtaccaccagatcaataaaatattttcacataaaaatataaacaacggcagaacggcgtgtattttatgctactggcattaaatctgttattggctgcaacgaaaggtgattttctttcgtgttttattttcccgctgccaataacctggaggatgctgaaattgttgttgacctctgcttactactttattgtagatggaggatgatgatgatcagggtgatgggagtaggaccgaggctgagaccaagtgtgtgaactgtctgtctatgggaacgtgtgaggattcttttgtggcctttttgggaaaggtcagtggaatgaacggactctatttaacggactcactagcaatggaagggaaaatacaatgtttcgttaccgagcaatttgagtttttcctatgaacaaatgagtttctgctccaactatgtattcgaagcatgcaaacaggtttttcgatgtacttattctgaaactaagacgctttgaagattattattatcttcaaacattgtcttatattgtctcttataaatatataaataaatattgcaaatattgtctcctatgtcttaagaagattcttggtgtctaacaaaaccttaaatttctgccatagattttgccagaaataatcaatggatttgtcaaatatatcataaatatcgccaagcttgtgtcaagaatcatatcagcagaatttatgaataaagagagataatgactaatgattctaatgattcttcctgctatttctttttagaacttttttttaaagtattttgaaaattcctcaatgagtccctctgtgtaatgtacaatgcctgttttgtgaatttttgttagaatctcactaaaaattcctctgtacattcatcaattactttatcattacttcaattgctccatgaatccttatacgcttccttgaaaaatctctacaaaatttcctgcgaatccacccattttcatgcattcctgaagaatttttcaaaggttcaaaggtctaacagctactgcttctgtttcctcacgcctgatatacagacagtccatagcaagtcagaatcacaagcaagtctctttgtcataaaattacacctatattttcccacatgaactggcgtagatgcaggggtatatccgatcaactctgcgccagttttgaattcatcatcaatttctcccccttcccctctttggtctgcattctgacgtgtcaggcgccattgttgcttaaaagtagaagatcaccagcacctatacactgagggtgtctgttggtcccaagcagtcatctggttggttccttgatctggcgatactgcagtagctatcacgggcggccaataaagcttaaggccgcacgggacgtcatcataatcaccctatccatttcaagaagcaaatctcaagaaccactccatatatcgatgcgaaaatgtatcactataattctatatatgtagtgcacaacccgataaattttcagcttcatcggttcactaaaactcgagatttgcttccacaaagttttgatgattaatgttagagtgagacgaaagatagggaaaataacacggtctcccgtgtccccttaagctcaagctggattgcttttccaaaacctacagcacaacaacttttctttcgtttttctcattcttgaacattatgtgcagaatttcctgagcaattccaacagaacttttcccaagcatatatgcataatatttccgtggtgaatttgtccagaaacaaaattcactttgatacagcaagtaaaaaaaaacagatgatcctttaaagacagcattcgaatctgttgaaggattgttcaaggagtcggttactagattgtgggaatgtctaggagatccactttaagaaatttcttgaaagaatctaccagaagttattctttaatggttcctcagaattgctttctgagtagtatgtggtattttgattgggttgcatgttccagtgggacgagcgacggaatcaagaccaatcgtgttcggttcgcgttattccagtgcgaaaagctccgtgttcagcctaggatcgattgcctgctgataaactggtgttctcgtttcatcagtttcaacccatttcaatcgttgcaaagctacttttatgttattttcatacgaactttgaacggttcgtcactacaagtgccgacttattcctgtttcctttgtaacctttaaattaagagcgtttttttttcaaacatactttcaatagttcgtcactacatgtgttatttctgtttcatacaattttaaaatacacacacttttctgttttcgacattacttaaataaccttggagtagttcgacattatgaatgtcgactttttttaaacttaattcatcatattttcaaccacgatactaatatgcaaaacgagttttaagtaagagttgtgttttccctccctatcaatggatcgtatcatggaccaaaggtgactcccatatcgttttcctctctcactaaccacacctttctcttgattatcgtggagatgcagaggttttctcggtttctagaagcaacaatcattacacaataacgttcctccccttctcaattgactgtaaggacttggccggtgccgttattgatcaataatatgaaagctgctaaaattgcacttcgagaataagcggaaaatcccatcccttattaatgtggatcgaagtgcaatttcgaccagttctgatcaaccacagagtagcaaccattgacatgtacagtcagtctatgctatgctatgctacgctattggttaatcaggaattgctctacgaatcattccaggatttttgcagcgatatcactgaggggataggaatagcaccgaggaacctcctaccaagcatttttacctttcttaattctacaagtatttcttcaaaattccttcaaaaatcatacctagaagtttcgcgataactttaactgagagctagtaattatctcttcataaattaaaatggaatggtgtttatgtgtcacgagttggcttgagaacgattcaatagattcaagaaaatatttcacagttgcgttgtttaaaggctgccacgtgttcgtgcgttgaaaatgttaagaaagtcttcggaatagtctgaaaaacggaatagtcgataaaattaatctaggcaagacgaggtttgctgggaccactagttgttattaatttatgaggaaattagaagtcaaatttattctgtcttcttacacttctctgtttttatgtatctttgtggcgactaaacaaaaaaaaatcaaaaaatcaattgacattttttcagttcttttttaaagtatttttcgaaaattgattcttaaaaggaattaaggaatttgtgaagttttgctataattccagaaactcttttttccttcaagcgaagttgtttgtttcgatgattcatccaaaaacaatttttgaaaaatcgaacaaaaaatcgttttggtacatctatatgcaattatctgaattgcaccgattattctattctaaaagccgtttggagtaaggccaaaaataacagcaaagattatttcaggaatgtgtcaaaatcttgctgcacagaatctttcaggcagtcggtagataagacattttcctaaaaccccaagattttttcattttttttttttttttttcaatttctttattagtatcattctaaacattacattcattatttcttatatctaggtgttctgtgttattagacaacactatcatcctaatttggtaaaacaaatctaagattttattaacattttgttaacaacatattacatttcatttgccgtagcagttcagattttttacaggtgagttgatttcacctgcttataagagaaaaaaaaaagtttttaatatacttaacctaacttaacctaaacatataacgcattaatcgtggcaatagtagattgtaacgatttttgcctgaaattattgattattttatttgacatttgttccaatgtttcaacattggatatcctatgtaactcattggtactataccagggagaaaacctcagaatcattttcaaaattttattttgaattctctgcagagctttcttcctggtattacaacagctagtccatattggtacagcatacaacatggctggcctgaaaatttgtttgaatatcaaaagcttgttcttaagacaaagttttgattttctattaataaggggatagagacattttacatatttgttacatttggcttgaatgccctcaatgtgatttttgaaagttaaattcttatctagcatgagtcctagatacttaacttcatctgaccaatttattggaacccctctcatcgtgacaacatgtctacttgaaggtttcaaataaagagcttttggtttatgtgggaatattattagttgagttttggaagcattaggagaaatcttccatttttgcaagtatgaagaaaaaatatccaaacttttttgcaatcgactacagatgacacgcaggcttcgtcctttggcggagaggcctgtgtcatccgcaaacaaagatttttgacatccctgaggtaactcaggtaagtcagatgtgaaaatattgtataatattggtcccaaaatgctgccttggggaacaccagctcttacaggaagtctttcagatctggagttctgataattaacctgaagtgtacgatttgacagataactttgaattattctaacaatgtatgttggaaaattaaaatttttcaattttacaatcaaaccttcatgccaaacactgtcgaatgctttttctatgtctagaagagcaagaccagtagagtagccttcagatttgttggaacggatcaaatttgttacacgtaaaagttgatgagtggtcgaatgtccatggcggaatccgaactgttcattggcaaaaattgaattctcgttgatgtgggccatcattctgttcaaaataaccttttcaaaaagtttactgatggaggaaagcaaactgattggacgatagctagaagcttctgcaggatttttgtctggttttaaaattggaacaaccttagcatttttccatttgtcaggaaaatatgctaattgaaaacatttgttaaatatatcaactagaaatgataagctactttctggaagtttcttgatgaggatgtagaaaattccatcatcgccaggagctttcatatttttgaattttttaataatagttctcacttcttccaaatcagtctcccaggcattttcgaaaacgttctcttgattgagaatattttcgaactcctgagtaacttcattttcaattggactagtaagtcctaaattaaaattgtgcgcactttcaaactgcatagcaagtttttgagctttttcgcaattagtcagtaataatttgttttcctctttcaatgccggtataggcttctgaggttttttcaagattttagataatttccaaaagggcttagagccggggtccaattgagaaattttattttcaaaatttttgtttcttaaatctgtaaaacgtttcttgatttctttatgcaaatcctgccatataattttcatagcaggatcacgagtgcgttgaaattgccttctcctcacgtttttaagacggatcaagagtttaagatcatcgtctataatcacggattcaaattttacttcacattttggaattgcaatgtttctggcttcaacaatggaatttgttaaagtttcaagagcattgtcaatatcaattttagtttctaaagaaatgttaacatcaagattagagtcaacatacgtttcatatatattccagtcggctcgtaaataattgaaagtggagctgataggattgagaatcgcttcatgcgatatttgaaatgtaacagggacatgatcagaatcaaaatcagcatgagtaactaattggctacaaagatgactagagtcggttaagaccaagtcaatcgtagatggatttctagaagaggaaaaacatgtggggctatcagggtattgaattgagaaatatcctgaagagcactcatcaaataaaattctgccgttggaattactttgagaattattccatgaccgatgtttggcattaaagtcaccaatgacaaaaaattttgacttattgcgagtcaattttcgcaagtcagtttgaagccaattaacttgctgtccagagcattgaaaaggcaaataggcagctatgaaagtatatttaccaaactgtgtttcaacagaaacacctaaagtttcaaaaactttagtttcaaatgacgaaaacagttgatgttttatacgcctatgaatgatgattgcaactcccccacatgccccatcaagtcgatcattacgataaacaaaaaagttaggatcttttttaaatttggatccaggttttaaataagtttcggtaataactgctatatgcacgttgttagctgtaagaaaattaaacagctcgtcctctttaccattcagagaacgagcattccaatttaaaatatttaaattattatttggatccattagaaaaacgtaatccaataacaattttatttgtaaattttacacctacttggactgcttcagtcatagtggtggctttgaacattgcatcaatcattagattcaattgttcagttagaaaattaaaatcagaggcagacatatcatctgatgatttcccattggaattttcggtagacgaagaagcggggtaggagttacctgtggcggtagggttttttccatttgatttgaaacaagtagaatgggtactcatggaacgaacaggggaagagttcaaattacctgctacgatatcggcaaaggatttaccgtgggtagatacattcgaaattgaaagattcgaacggctacccgacggattaaaatttgtttgtgaatgagcatgattatgatcttcctggtgggtatgattcctaatcaagcgatcgttaactgaaaaatgagcattgttcgatactctaccaggcaaattccggaaacgaccgttatcgtaacggatattatctttcatctgcctggcacgagcctcaatgactcttttgcgtgaaatgcattcccaaaagttagctttgtgagggcccttgcaattggcgcattgaaattttctggtatcttctttcacaggacagtcgtccttagcgtgagaagaacctccgcaaatcatgcatttagcatccatgcgacaattttttgtaccatgaccccatttttggcaccgacggcactgagtggggttctggtaatttcctccaggtttctggaaatgttcccacgtcacacggacatcgaacataagtttagctttttctaaagctttaatattatttagttcttttttgttaaagtgaactaaataatattcttgagaaagccctttccgaacaatgccagattgggttctctttttcataatgattacttggactggggaaaatccaagtaaatcatttattccatttttgatctcttcaggtgacttatagtcacttgagagacctttcaagacgactttgaacaaacgttcagttttgtcgtcataagtaaaaaatttgtgcttcttctcttcaagatatctgagaagaagttcgcgatctttaagagtttccggcaaaacgcaacagtctcctttctttgcgatttggaaggaaaccttgattcccctaatggagttcaagatctcctgcctaaatcccccaaattcggaacaactgaccacgataggcggcactctttgcttcctcacttgaatcaaagagcctgggctagaggctgcttcgatttggtgttcggaaaatttgtctagagcatcgaactgattgctcatttcaatacaattattcatttcacccttggaagaaacttcgcattccggggaagcgtcctttcttccattcttgccacgtgtagtgacagttttaaaacccacttttttggaaggaagtagtgaattcagcgattcacccttccttttgttagttgttgataccatgtttagttaataaacgagaaagacgtgaccttcgagaggttttttccctagacggtgtccaagaaggattaccaccgctagctttcgccaacgggtccaacgaaaaatcgaaggcacgggtccaaacaaggatcgtaaagggatcaatagtagaaaaaatagtactgaaaagtactgtttaagtagcactgaaaagtaccgtttttaattttagcactgaaaagtactgtttgtgtagcactgaaaagtactgttttattgctttaggtagtttttaagaaaacttccaagagcagagaaaattcgtgtacgcacagcacgaaggtacgatgcgcactgaagattttttcatgattttttgtatcatttattgtatttttctaaaaaaaaaacccttacaatgctatcctctaaagatgtaacagaaattgatccaagcatattaatgaaaatcctacaaaattattttaactagaatatccacaaaacattccagggaaaatttgttggataaatcatggaagaacgattattttattaattcctaatcgtatttcatcgagaatcctaagaatgataggagtgaagtatgaggaataaggagtgttcaatgagaaatgagcaatgatgaatcaggagtgagaagtggagagtgaggagtgaggaatgaaaaatgatcagtaacgaatgaggaatgcggagtaaggaatgataaatgagaaatgaggagtgaggagcgagaaatgagaagtgaagagcgagaagtgaggaatgaggaatgaggagtgagacgtgataagtaaggtgtgaggaatgagaaataaggagtgaggattgaggagtgaggaatgaaaaatgagaattgaggaatgaggggcgtggaatgcggaatgaagtgtgaaaaataaggagtgagttgtaaggtttggggattaggagtgaggaacgatgaatgatgaataaggaataatgagtacatattgaggaatgaggagtgatgagttaggaatgaggaatgatgagtaaaaaatgagatatgaagagtggggaatgaggagtgaagaatgaagagtgaagtgttagtttttaggaatgaggagtaaaaataagaagtgtggaatgaggaatgatgatggtgatgaatgagaaatgaggaatgagttgtaaggaatgaggagtagtgaataaggagtgcggaatgaggaaaggggaatgaggtgatgagtacggagttagaagtgaagaatgaggaatgaaaagtgaagattgaggagtgagagttagaaatgagaaatgagaaattagagtgtggaataaggaatgatgatgatgaagaatgagaagtgagtagcgcgaaatgagaagtgagatatgaggagtgaggagatatgagtgaggaatggggagtgagaagtgaggcataaagagtgatgagtgagaaacgagaaatgagagatgaataatgatgaattgggaaagaggagtgtggaatacggaatgatgatgatgatgtagaaacaaaatgttgtcacatttttggaatacatgtatgttatctatagtttgcaagaactcaaggacaacatgagataaatgaaagataatatgaatttatttattgtttgtttacttatctagtttatttggcaggctcagacgccgtagggcataacagagctgaaatcttttctttttttagattaatgaatatatttattcattgaagataacagaagaaacttttttatgtattattataacagtcagtcttgtacagtgtttcgagcgatgaagttgtgctggaattgctcacagcttcaattcagctgatcctgccattagataggcttgtgggggttcctccctccgggcacaacaaagttcatcaggaaacaacgataacaaagcgaaagaaagaagtgaatgcgaatagtaagggaaagtgaaaatcgctccaaaatttacgtatcaatttacaaccaatcaacgaatttaaagaaaaatcatattaaattgctcatgatacctatctttgatttattctgcacaagactatcatagcatttgaaacgaactacaagagatttttgtatagatgtcttaacacacacaattagtgattttttggatttcttggctcattttttggcgataggctcagtaaatttgtctacaattttgacaaaattgggatattcaataaggatctgttgggattctgttattatctgccgcacacgatgttggtcaaggaatgcacacagaaattgttaagaacaactaagggtttaaccacggaattttgcgagaatttttccaataaccatggtacggaattatcaggctagtaaagtgatcaccaaaggaacttggaataagacgttttgtttggaatccctgaccaggaattgaattttgaaaaaactgagagtatctctcacttattcctgtctgctctacatactatacatactatctactaccatttaactactctctaccttctaataggaaaggctcacaacctactaatataaggctcattcagataacctaatatttaaacaaacctgtatgtgataaactgaggcaactctatttatgttattgagagccttgtcaatatgtaaatcattctacaacaagtaatattttgcgtttgaacatctttttttaagtatgattgtgctaaattaacctttatcatttgaagaaggaaaacataaattctacataattattgattcaaaaacgccatattataaatctggtagtgagtcacttctttcacttggtcacttttttcgacccctttaaagtcactatttgcaataaaaagtcactaaagttacatttttctggaaaaaagttactaaggcgctattttcgtattttatgatcattattatgaaatttaggtcagcatgtctaacaacagcagaaagttgaaatttgttattataaagaaaaaaaaatagtgtaatttggaaatcaaagtaacaagagattcttagataactttctggaagaattcaggtaaattttacattgacaattccaacataatgttaaacgtgaaacaaaattctagtggaagttttgaagaagattctagcaaaaacttaaaaatatttgaaaaaaaaatgtcggaaaccagggacaatatcggactggctgcttaaccttaggctacagaaggaatcttaactttctgaaaaaacacgctttgaaacgctttcggaagataaaccaaagacggctagaataacccaaaaagaaaaatgcaaataattcgtgaaaaactcttccaggacttcaaaagcaagtgctagttatcatatcagaaattacattagaatttccaacgaataaactttacatttttccattgtaaataattgatactgttttttttcaatttaagtaaactacttatatacaaaattacatgtttctataaagaattcttgaacatgctagggaatctgtccaacagattcaatctgttcataaatttcagcaacacatatgtacctgatataaataaatttcataaaaaggacatttttcatcgtttattgtttgcttcataaacaaagtatgaaaaattaatcattttcagggtcgtggaaaatatataacgtgaggtaacgaatatccttgagtgatatgattgtttccaatagttcattcattgaaaagctcagttgaaaagtaaataatttaagtacgcatggaatcattttctaattacatatgtacaacattcatctaatttagttttcctagaggtcgtcaaaaatcaattgttttctggaattacctactttttatgtggaagaaaagatttaagtcaatagaaaaacagccacaaattcagcctgagtttattatttttgcatgtttttgaattttggatttcaccgtgatgtttttagaatattcagaaaatcattcattcatttttaaagaaatctgccacaaagttgtctgcaatcgaaaattttctcatgatcatcaatgaattttgaccagttcctcatgaacaggaatttcgttaagaattctatcacgagtactttatctggatttcatgtatttgataaactacaagttttcttccggctgaaatcagaaatttaaaatagtaacgtataccaaggcaatattggactcgtgataaaatgtggaatgaaaactccaatgcgtcatctttttgacaatttatggcaatcaagtcttatcccgggcaagaaagaaatattgcaaattactgcagttctctagattccaatttcacctaatatgtaggttaaatattatccacatgaaacgtatttgcatttctagtcatttttatgactaatacatgtagttttgatgtcgcgaataccattattctgattgactcttggccccgacattactccgaattccaacatcataagacattccagatgactgttcttccgggcaacagtattcgggcaaatattttagataaagataaaagatagatgaaaaggcatggccttctgtggtacaaaagatgaaatagagagagttaaatctagaattgattaagttcacagcaatctgtcaaattgggttcccaatggtcaagttgagtttagaaaatgacacttagaatggtacccgacaactataaataaatttcgtcttggatgttacaataaagttatgttcgactactgctaaatgtcacttgttgagaggttggttcaattgaaatgaaattaaaaaaaaaacattattgagcctaaaacgaattttctttccttttttaacattaactactattcccccatcaagcatgaatccaaaattgggaacggaataaattattttccacctcatttgcttttcccaattgctcgtattttatgcatttcgccagacaatgtttttcttatgcttgtagaaacctagaccatgtctgctatttgagcaaaagaaaaacgacttcttactggcccgccaagaaaaacggtgagaaaagcccttcgccttccatcgcaccgcccctaagaggggacagttttccccatctccgatgataaatggcaattggtcagcttgttggtggtgccggtggaggtggttacaagattttctcactactggtggcgacaggacttggggtcagagcaattctttttcccaaggctgcatccggcaaaaaaagaacatttgtatccaccttctcccttaacaaggggggaaacgaataaaaaaaaggttgcaaaagtggtctctccaactaatgttttgccattaaagatgggtgggtaaggagaggtggcaaattgttgagagggctttattttattgcgaattaatgtcgaacaacagtccggagtcactaacctgttctgctcatttcgtttttcattattatgagggggagatggaaggtggatggagcagtaggctgggtcgtcgtcggaagaaaattgccagcgacctaagcctactacggagtcaaacgaaggcaaactaatagtcgaggagtcaatgtaggcgtatcgtaacagactgatggggagttcacatatgtgtttccaacttgtagcgtgtgctttacttttccccctcatactttgaggggggaggcggtacacagtggtttcatttttttctacgaagcgatcataaatcatttttttttacaatatcttataaaaaaacttcttcaagatatacaaatcaattatattgtgttctttaactctaattgtttcaattgattttggtttacgaaaacaataaacaaaatgtaataatagcttaattttttaacacattttcttaaaacataaaaaatctactcgggaattcatggcgttgctatacatattctacagggacgtttaaaaaatgagtttacattcttgagaacataattgacccatgaaaaggtaagggactgaaaagcaaaacaacttattttttggtttttggcctcttggtggtaccactgtactggtggctgaaagtgagcctcatcgcgaggggagtgaattaaatctgaacagctattgaaaaccctagtcgtgtgcttgatgaaccgtgtagtttcattcttcctgtggttgttctgtgaaagatagatgtgcctttcattattcaatctttcaatcgatgttgtttaatagacgttttgtactctagtgtgtgatttttctttggtttccttttttctatcgcaaaataattgacgttctgtttctttgtattgattgtactaacgaatgatagatgttttcctacatatattacgtgtctattcagtaaatgtttgttctttcctactgtacttattacacctgtttgtttcgtttgcaaaattcactatcccatattcgaagttaccgaaaaaccaaatcccaaacacccaccgaaagcaaagattcactgaacgaatggacgatttttctttcttttttaatttcagatgcttatcgataaaaccacctgagaggtaggcgcatacaagtttagccccaaaagaacctatcaatgagcgtgtgttttttgcgcgtgtaaatgagtgtggttgagcttcccttcatccccgccacaaatcattaccccacaacccattggccaaaaaagtcagcgagcaagatcatccgcgagcgcgcgaaaaaaaagtccaatcgacgcagtaggtatattccaaggcacatgaaatttatgacaccatagcaaaacccaagaatcaaaagaatgcaatcgattttcacaccaccacattcctccttctttcggatgattttgttctcgcgaaacaagatggcccccggttcaatcacaacattgcacgcgattttcacgagagatatagtcgttagtacatcaagctatggctgattcaatttattgaccactcgtccagtggggaagtagtttgtgatgatttccgctcatagatttatttttccgccccattgttcagtcacgaatcgacaccgatccgagtgttcggtttggttcagtgtacgtaacaatcggaattgactttagccagaaatccgacacactactcgatcatcaatggtccacatcgaggtttaaaacaatgaaaaccgatgatgatgatgatgacgggccgatttattatttttgcaatggaaaacagatacgacacgaattcggatgcatctatcatcgggatattggataacgggcgcgcgtgtatataatatagatttattagtcataaattaacctgaattgctttcttctgttatttttggtttccattcggtacggttgttggatggtggaggaatattgtaaggttgcgatcataaattaatttcgagtagttgacagcggtagaccgcaaaatattgttttgttttagggtaggaaaagtcgtgggatttgcatgcaaaatgaaatccattggaacatggtttacattaaaaatcatagtaatttacacgataaatccagaaatgtcaacattttggcattgactagctagtatagatttcaaacttactattagacgatgacagttttgtttccacacccagggaaataagccgtataagccaatgaattatggttcaaatttaaagttatttagagcaaaaactagtttcaagtttgaattgaacctttccattaatctggattagtttcattttgtatatatttgactgatttttgacattttgttgaaaataaaaataattttgttagacatgacgatttcattgccggcaatattacgcgatacggaaaggataatgattatctactcaaagctcccccaaattgacgcggttttgtttttgaatcgcttcaagcacatctagactgacgcgactaaaatccctgtcactatcgccgttaaaaaatcgcgttgatttgggtgacccttcaaagataggccagcgactcactgaccccctaatagatgtcaaaaagctcaattgtagggaagggaatggtccgggattcactgtaagcaagtgctacgaccggaattaaattgttgggagtgacgttgctaagaaatttagtgtctcttcatgcgtgtgtcttccagggatgaggcacaggtatttacaccttgtcttcttgcttaaaagctttggtttaagcgccattgctcggtctttgaaacgagtaaacaaattgaccctaccttttgaaatagcccaaatttcattgaaactaagtactggaacaagataatccgatctgatctatgaatatcattccttttgtaacgcatctggtatgaaaaacgatgttttctaagtggttttccacatgtgttgtacgacctacaatagcgcaaccctagaagttttaccattgaataaaatacggtttccacaatgattttcattcactttgtacggaaatatataaaatgacgatcattaatgaaggggttttcgcaattcaatacgtatacttttcaacagaagcaaacactaaatggcactatcaaatttttcaactatatgaccgctgcaatttttcatcagaatcacaattatcacaagcgaaaggaaaaatatccgggtggcgtagcaccagacgaactgcgtaaaaatctatcacgcataaaacaaaaaaaacgtgatgggcagttgaaaacacaaccactcacagcgtggcctactgcgttttttaaatgatttttttaactggctggctcaactcgaaagattcttttaaatgaatctgaacgataaactgtcatttaacactataagtgaaatatctgtttggaatgcgacctagcgtattgtttccaaaaagcttcatttttatgcgaattcaaaaaaggaattcttgggtaatcttgagtgtcattcagctcaaaactttgataaactcataatcgtataggcacaattattgtttttaaatcttcaataggtcactccttgtgctacttaagccgaagatttgacatactcttttgaaggtacatgtacaatttttaccttaaaactggtgtgctattccttttgctaaaagggcttatgtgtactcttttctagttactgatcattgcattgtcgatcaaatcaactaacatttcgaagaaaccagaacttgcccacaaaacaggagatcctaccaaattaaatgaataatatcttaattgaattggcacgattaattcaaaaatgataagaaagcatttatttttagctatcggtaaaacaattggtacggtatttgtctatggttaaactattgatacacaatcaacaatattgatttgaagtttaaaaatactgaaatggtttaaaatatttgcaacggcttttattcaggcatgttttctaaaaatgtcgttttgtaactattaaattattcaagcttgcatctcccatagagtttgaacaattctttagaaaagcttaaatgaaggacaatgcttgagattctcttcaggtccaaggtgtgaaaattcactcttcttagtccttctggttttccacagaaaaaaaagttctacacttgaaacatatttgaaagactataatattacacaagtcaaacggaatcgaagatcgagttataaaaaattgtctgaataaatctctcattaggtttcttgccatatgcgtcgatcgaatactattacattttaaacgtaatatttttgtaaaatggatgtaatcgaattaatttacgttcgattatagatacatggctaaatactacgtcggcctatcaccgtattacagatagaaagtgcaatgcaatgatagattttcatgaagattggtttgattttgagcaaaaaaactggttttgaaaatttttcctcttaagaatcaactgttcattgaatttcagctttaaaattcattacaagctagtggtcccagcaaacttcgtcttaccatcaagtaggctgtcgaaaaatggcatctaattccaatacaaaattacagattagttttatttagtttctcaattgttccggagactatgccaatatttatatatgcaggaacacgtcgcagcccttctcgattttaactgtgaaattaaccgttgaaaaaaaaagaaaaaaaaaggttgatacttttttcaattattcaataactcttgtattagcgacaaaatgctactcccgactgtcagactaaacgtaaaactttgattccatactatttagattcaaacactatcctttccacaaaatgccgattcgaccaaatataatgtatttattttgcttaataaaaattgctttttgtacatctggtactactcttgatgtttacgtccagttttccaccgagtattgccctcagcacttaacataaaagaagttttgttcaacattctcagccacaacaggattataactacacgagaaacatgattgtcatatggtcggtgttcagacagactggaccaagtgttctttaatgttttcaggaaaacgtaccccaagcattcggtataagtataataaaattcgtgcattaaatatttgctgaaagaaaggaacttatatatttgaagaaacatcaatagaattcgaaatattgtaattgatagagtccttgactcatctttggaaggccaaattgtcatttagtcagatctgtctgaactccgaccatatgtagcaagtgttcgacgattaacaacttcaaacaaattcccaataagtactatttaagtatcaatttcactaggactttcacactatatacctgtgaatggttggttcgttttatttttttcgggattcatcgtcaatctgtttattgacttctaagtcgcgttcgactcagtaacaaaaaaaagctgttgcaggtaatatcaaagacttaacaataagacttaaagctgattaagctgacaaatgcaattaggtgtaagaattatagacgaggagcttattttgtttttttttggaaaattacatggaataagaacagatgagtttctgaatttactgttcaatattgcgttttgtcgcatatactccttgattttgcagacaatgagtttattggaatcgatcgcagttcagtaaagaagggtttcactatttcaaagatggacaactaggataagcttgtaatgccatttactctacccaaacgtatatggttgcatgtagagaaagaagcaggttcagatgtgttggtgctgaagcagtgcttgattgagatgtggatgaatttgttgtagagccatataacaattgtgaccctttcccttggagtaaaaacacgtgttctggctgcgaatatctcctttacgtattacgtaaccagtttagggacccgaaacttgcaaagggaaacgacatttctacactgttacttgataaaggcttatctgacttcatagatccattatttcattgacaacttcgccaaaacatctcgcgatcctttattgtacaacactgaaaagtgtttcgaaaaccaaatcagatttcaattataatgcaaagagagcaacgatgaatgcaagcatagggtgttttatgtattttggacagagcgttacgcgtatataatttggcaacctccattcgattttgccgtaaatggccaaattatatacgcctaacggtctgtccaaattactttgatcgccctacctaaaagaagcattactattaatttgtgatgtataaaatgcttattcttttctcccttaacacatttatttgagaacaggggcgaaaactattgagcgaataaaataggtaaacttcagtgagctggtcatttagtgcgaatgcgaagaaaaagttgcatcagtcaggtgaagctcagcgaccccgtgaaagacatcggcgtatgatcattctgctattgactagagcgtgccagagtaaccaaatcattcaaaatttgaaacaatcggtaatactagctctaattgactataaaagtattcacatgacttatctgctaactattattgtgcaacatttattctcagatcctttttttttctaataacaacattgttaattattgatttatttggtttacttttcaatcggtttaatatggaacacaacaatcaatggaattttaaccagtaaactatgaaaaaataagttaaatcgaagccaaacattaggtttttaagatcatgaatctggaaaaccaaacatcagtttaagctgaatacctaatagactggtcactagctcttggtgaccaatcgattaaatcctctgttcaaacgggtattcggttctccagatttgtgctcttgaaaatttgatgtttggcttcgatttaacttattttatcattcatcttcaccttaaggagtggattaagttaagccagttgtgaatatttctaattttaacaacagtaacaattgtatactagttaagggggcaggatccgtcattgacttcggaattttcaaaagcagttttttcattcaaaatcaagcaaatttacaggaaaatgtgttcactgtattctgatctccaactgaaacgcagtgaacacattttcatcgaataatttttaatattgaacagaaaaactgtttttgaagtttcgatgatgacgatgataacgatgacggagcgttgatcgttaaggacagtttggccaactttctgagcatttttgtaggttttgtcagtgcgattgcaaaattttgatatggattatattgaatttttaagtaaaagacttcaaataaagatttctcgaaattcctccacaaagtgaaataaatcgcttctccgagttggtatgttcacaaaataaaatgagttcgtccaaccctatttgggatgtgcttttatttgacgtttcagcagtgaaagctcaataagattatatttaataaggtgtggaagaagaagcaatggctatgtattagtaaagataaaaaacgtaaacaaaaatattaacgtcacatatttacatggcttcttatgggtgctcgcttgcttgtagttgagaaacattctgcatcatacatggatgtcacgcacaccaaatgtctgcttacttacttcggtatatgttctcattggtgaaagctcactatttcttgaagacttattcaaacagactcatgtcaaaaaagttagcaaacttactttatcaatccttcgcgtttcgcagatgaaattctacacggttcgctctgaaacaactcgattttttacttttagaacatttaatttccggatttacaaaacgacaaaagtaagattctccactttcgcaatctaaccagtactttcgccgctccgttatatgggacaaagtgacttaacaacgaatcaaaataaaacactacttgagtcgattttacactggtacaaaaacgtcgtatgtaactgattgaaacggcgtatcattttgtcgtataatctttatgggaaatgataggaactacctagtgttttaacgcgagctgattgcatgtaaaattttagcgatgtacacggtaaaaaaaatgttaaaaaggggattcattttaaaacagttttagaagaaaggttgggattcttcttaattaactttctcaaaaccgtatgaaagttacttacgtcgatttgaagaagtaatcgagatttgtgtcgcttcgttcattttggtgccatactaatgcgatgtgaacatgcagcattgtatcggtgactgttggaattgaatgcgtgttcaacattgagaagggtaggaagaagacatttattgtgcgtgacatccgtgtacggtacaaaatgtttcacaactacaatcgaacgatatctcataagaagccgagtaaattactgtgtagttatttttgtttatgggttttctctttgcgaatacatagtcatggcttcttcttccacatgttattaaaaactctcattgcacgttcattcaaccgctcattgccatacctaaataataaagaatgaaagggaatgaaatcgtagttcttcgagttatcgactgcaagcgtcagttaccatacccattacaaatagtaacatgtaactgaaacagattgaactcacttcccttagcgtggaggccgacagatatcggacgcgcctttcactcgatagactatcgagatctatcgatcgctagacccctagctagcgtaatcaactattatgggcttttgacagttgttgatacccatataggtttaggaacatacattatttcaagttttgagttttacaacagtcatcgttcatccaagtaatgcttggaatgaagaccataagtaaaaactgatcatgcggaggtttgtcaatatattttatatttattcttttgatacttctatcagtacagcttttcacatctatcctttaagataaacaagcgtaattagtgatttttaagaatttgcatgaacaaggttcatactccatgaggcgctcaaaccatgtgctaaaacagattattatgttcttgaaccttcaagagattctggtcaacattgtaggtcgaaggggctttttggaaacctcagacaataaaatcgcagaataccagccgaccacgtggattttttcattatttcactcataatttatccatcattacctcgcgtaatgatttaattaatttaataaccatgcggatcagattaccgcaaagctcaatatatgtgttaacatatattagaaagactgcctccctgtagtaatcatgtcgtcacttgaatgcgaacgacacgttgatggccttcctccatctcttcttcttctcttcttctacttggtattgatgtcctcattgggacagagtctgtttctcagcttagtgttctcatgagcacttccacagttattaactgagagctttatttgccaaagttgctatttttgcattcgtacatcatgtggcaggtacgatgatactctatgcccagggaagtcaaggaaatttccattacgaaaagatcctggaccgaccgggaatcgagcccagacaccttcagcatgactttgctttatagacgcggactctaaccactcggctaaggaaggcccctccatctctacacttccccaatacagatgttgtggaagcgatgtgggtatgaaaggcaaacagtttcaacacaaaataaatcgcactcgctctgcgcgcgtgtgtagtatacatgagatggatggatattggttatgataatgttctgcgtgatctgttgggatttgaattcgaaacttgtaaccaactaagtttttgggtcaccaagcggctcggtagcttagtttataaagcgctcgtctagcatacaagagtccttggtttgaatcctagccgagcacgtggatatttttcataatttcacccaaaacttatcgatctttctcgcgtaatgggttaattaatttaacttcagacagttttcagacacaatacttgatataatattttcgtttgagcctgaagcagtgatgcatttgaacgcgttcagttcgtgttccagttcagtttattgaacgggggatcaagtaggcttgctcattgttcagttcaaaaatttgaaccctcgagagcagaaaagtgaacgcagattgttttgaaacatttcacgccatctcaccatgctaatgttgattttaaggtgctcaaagtaagaaaaaacacattgatgtatgataaaattgaatgtattatcaattcaagaaatgtttcctcggtaaaacattaaattcatgcttcaatagggtaacgactgtgtattttgatcttaatcgctaacagttggcgccagtggcaaaaaatacagacaacaacccttcgaacattcagtttatctgtgctggccgcctagcggcgacactgatgtgtgtattcctttcactgatcgcgctacgctggattctcaaatttctcaagtttcaaacacaagcgcatggaagaatggtagtcggtgaactgtcaaaacgtatggaaaataatgaaaaacgtaattaggttaagtatattaaaaacgttttttttttctcttataagcaggtgaaatcaactcacctgtaaaaaaactgaactgctacggcaaatgaaatgtaatatgttgttaacaaaatgttaattaaatcttaaatttgttttaccaaattaggatgatagtgttgtcaaataacacagaacacctagatataagaaatgaatgtaatgtttggaatgatactaataaaaaaattaaaaaaaaaaaaaaaaaaaattaaaaaaaaaaaaaaatttttaaaaaaaaaaaaaaaaaaaaaaaaaaaaaaaaaaaaaaaaaaaaaaaaaaaaatgaaaaacgtaacttacttgcaattaggaaactggatcgaaaaagtagtgattagaaatattccattgtgctttctttgcttcaggatttcgtttttactaccactgaaaaagagtcgtctattgccttttcagttttgaatatcgccctattacaattgtaatgacttgcgatctgaacgggccgttcaagagcagcggcatgctctggctcgagagttcaaagtttactgcgttctcgtgcaaaaattgaacttgctctgtttatttttgactcgcgttccgttcaaaatgcatcactggcctgaagtgtaaattgctcagttgggtttgtttattgcaactttgcatttactgctattggtcaatcagagtgaaccaactcactgaacggtggtctttagttcagtcagattggaccaagtacacatagtccatctgaaaatcgttcaatcagattttttgattatgatttttcatgattaccacatcacattatattatttgaaagtaacacaaagatgtgtagaaatattgaaccaaattataaacgagttcaaaaattacagagcgttagactttaaacctatttttctcgaaatatgaaaaatgtcacttggtccactctgacttaacgccgaccatatgatattgtatgttactttgatggcttctttcttgaaggttatattctcatgagctcaggctccataattttcacccacttgatagaccaaccagcacgtaacggataaagtaacggtaattgactggactttgatgatgataattggagatttcgactgtcagtcccgaattaagcgttgagtattttaaatccttgccgcttaattcgtgactgaaagccgaaatatctaattatcagtattttttttagcataatgtttattctttacaaacaaaaacgacaatgaatattggagaagtgggagtgagcagccgtaagacgcaacttcgtaacgatgctctcacaagaacgctttgttcctatctaacattttgaaaggtgcatggaaaacattattcacccaaaatctgagtcaaagtctaggagtgtagagaagaattcgtttttttttgacttatgtaaaacaatacaaaatataaaaatatgagttaacgtgtatttccgacataagctcaagcatttggtacaatacattgaaatcaggctctaggaccctattgagggacattttttcaatgagtcctaagtcagcaattcccatttcgaagtaatgttttggatcaactcttacgcgacagtacaaacatttctgctggtttccaagatccgaatcgaagatggtcctatccgaataattgttgacctaccaccatgttccgttgaaccgcaggccaatttaccgttccttaccgttgttgttgtttttggttcaaaatacaactccgactcatacttcctcacatgtcaaacgggcacaactgctcgagagtgggaattttctaaaatactatactaccgaaggatttatgatttctgcggaaaagagctcgcactcacacggcacccagcagccgcagcgcatatcgagacccgcgcggataagaagtaaaacaccaagtacttgtaattgcaggttgaaatttgatttatgcattttattatctttatttttatgatacgattgcgcgcattttgcagctcggcagtcaagcagtcagtccgatcgcgggttgttctttactgggctcgggacgtaaccgcgtcagcggagagagccttcatcgaataaataaaagaaacttttccctttgctgactgcgaactgacgggaacttgcattactggaaacctccaccgaaagaggcgaaaacccgggctgcgctaaacctccgccgtgccatccgtgaattacaagaatatacacgtcgagcttgatttatttcggtgtgtaataaaatattaattatattttctacaaattaatttcgaaacataaatattccattaaagcccattttcctgctattcataatccttattagagctccgtacgttgtgaggtgagagacaccccggccaagactgccggaatgatctcttccttcacttctggcttccagccgtccacccttggaatgaaaagcaccttcttaccggtgcacacgggagtgttttttggtcaatggtggccaaattttttttctgtcctcaataattttcttacgtcctaatattgaataaaagaacgctatgtaaaaaaatacagtgggaactaaaacttgattttcgctatttggaattatgatcaccaatttgtcctagtttctcctctatgcggcgtcgtggattaagaaaaacgtgaaaaagtgaacgctgaaaaaacagtaaaccacgtcggccaccgtcagggaaaagccacccacagattttcatctcctgctgcatttgatgttgggtttgcagaaacaaaagtgccgatggtgggatggcggcaggagacggtggtttttgggcagcttactttcttacacgctttatcaccctcctgatagtattatgagacgcacggcgcgagccaaaaaccagttcaagacgaggtggaacgaagaaaaaaagaaccggcgctatttcgtgtttcgtcgtcgtcttcggaccggttgcggtggaggattaatagaattaaaacccgtggcgaaggaggggaagcgaagacggtgggggaatcggcacgtttaaaaggccttaaaagaaaagaactttggaaattaaaaattagaaatggatacataaataagaatgttgttttcttcacgctcgtgacggtgcaaattggagctgcggtggcggctggtggctgtgcaaatgaccgcgaggggactttcaatggatcatatttcaacgggtgatgactggatgggtgaatggttcaatttcggttgcgagggattgggaagagtaaattgcttaaaaaaaatttccattgtctttaatggttacgaatgggatatgaaaaagatcggtaaatttatgttaaggattttgatttaaaatttgcaattcgcaccgaacctacattacattcccaaaacctcctggttttattctagcctcccgctcgataatcaattttcattttttgttatggtttgaataaaacttaatagattcaattacttatgggttaaaaacaatctgaaaactgtaattaatctttgaactgcatagtggaatacctataaataaatgaaaaaaaacgaatttagtattataccatttaatgccactagagtttgtatcttttgacagatacgcgtatttcgacctcaactgtatgaccgtcttcagtgtcgtgttctagaccttacagttgaggtagaaatacgcgtatctgtcgaaggatacaaactgtagtagaattaaatggtacagcactaaagtcagtatggggccttccttaaccgagtggttagtgtcggcggctacaaagcaaagccactctgaaaatgtctgggttcgattgtcgaatggttgaagatctttttctaatggaaattttctttactacccaaggcatagagtattatcgtacctgccacagtatatacgaatgcgaaaatggcactttggcaaagacagctttcagttaataactgcggaatagacctattcatattttcaaaaatgtctggaaattccccagtcaaccaatactttgatttttcattgcaaaatgaatttctggccaaaatttcactcaatttagagtaaatttagttgtgcttcaaatcaattatgtgtttttgggctattttcaagctttaaaaaatcataattaccgaacgaaacatcaaaatttatcagaaatacttctacatagtagtttatccaattctacgaacttttgccgaacacaattttatgattggagcaagtattaacatagtttggttgaggtttgtatctcgaggttcttgaaaatctctttttttgggaattgttttcactgaacagcatgcctgcatgaatatttcggatttttaatttccagacatgatgacaatgcatatctaaaagtcaatcccgttcaaagtaaccatttatcttacgaaaataaattgtaaaaaataggtaattatgaagcacatttgtaaatccactgtgggtgagccaagagcaccaccgtgagcttcaatgaatacaaaaaatgaacacgttagcattgccttttctcagtcgatgatgatgattgttttcaaatccttctaaatgatcagtgaaatgcgatcaaaacaatcatcacttggaaagaaaaagcaatgctaacttgttcaattcattcgtttccggtacatgtgtcatgcatgatttaactatcatcaggttgcgatgcggtgctcgatctttgggcatttattgtaatttattgcctttagcaacatgtaatctgttgatggtcaatgaattcataaatgtattatgtttgattcccgttgactaggccctgaaaaaataataccaatgcatgttttatataccatgtatattgagaaaactgtaatttctgggtactgcggagtacaaatttggatcaaacaatgttaaaactcaatttaatcttgttagcgtgttcgacaaactttaacagaatagaattagctttcaaatagtggtaatagcaagtggttttgatttttcacatgctagttatgatttttcaaaccttgaaataacctcaaaaacacattttcaacttgaagcatactgaaatctttatcaaatgagctgaaactttgcccagacattgctcttagcatgataattccgaatactgcttgactggtagatttccacaattttttttaaatatgaacagatctactgcggaagtactcattgaacactaagctgagaagcaagctctgttccagtgaggacaaaatgccaagaagaagaagaagaagactaaattcggtttcatcaaaactatgtacgattcggtttagtgtgatgaaagcaatttaatcaggaaacatcatttaaggtagcattcacttatccaacttaactgcagagcaaagaattctgaaaagtatctcagctagtagcattttaaactaaaagccgtaggtctacttttcattatccagttaatactaaagacgaccttttttatcttcacgctatgctttattccctttttccagcagccaagacttttttgtttgtaatttttagaaattaacttatcatgaatggttacaattgatcacataggcgcaatacatcactattcagatcatgttatgggctcagagctatccttaggcctcgaatatagttgaaagtttgtaccttctattcagaatattcaataaaaaatattgtggggtcagtttgcgaaataggttgcatgctattcacagaccctcgaacataactagaatgctattgggatactttttggacaatctgagcaagttcaagtagtttaaccttcatgacctacatgttctagcatagttcatatttgttctacgcataggtagaccaccgttactacaaatagaaccttgaaataatgccaatagaacgtctgtgacgaactgtgttagttagcaatttgaagatattctaaaggcctacataacattttgaagtgaagattgagccgtcgcatgacatgtattgaagtttccaattgtcgccaatcacagtttccctcgggcacatccggtggcccaaaagaggccactgttgtcaaacatccgatttgagtttacgtttgccctattcatgacaagacatgaaaaacgaaccattgcatgatatattttggtgtcaaaactgaaatatcccctatgaaaggtttcccgggacacttggcacctaatctgtccaagactcattttaaatttttaaaaggatcatttatgatgaactacgaagaaagaaatattccacgtcatgttttgattggataaataatttgatcccaattcggatccactaccgacaccgattctgtgggaatggacatatcttagttgtatctgaaccgaaattagtacttggtgcgccaatcgcttcagaattttattttctatctccgtgtgcagtaaaattttgaattttaactgctaaaaacacgtcataattttattgcattagacatgcttccgaaaatccggataatcaccggtatccggtggtcacagttcatctccgtggatgcacctcacaacaagataagttttcccgtccggtacttcttaaagaattaaaatcggtcaacccactgtatattcaaccacagttttacagcatgactgctaacagaatctatagttaggggctcctgttaaggtacagggtaactggaaagatttctgtatgtttttcaaaatctgtggaagagtttcctaaagaaatccttaaattaagcttatcaatattttttaagaaatcattgctaccgtttttatatgcatctctatatgagtttcggtgaattgagagtattgattatattccgtcagtagattttggtgctaattcgaaaataatttcagaaggatcacccaaaaggatttctagaggaaagtttaaaagaatttacaaaggtttactcaaagatatctgtgaaagaacttttttttaaacccttgaatgcttttcattaggaatcttcagggaaatttcacaggaaatcttaatggaacgaagacatttttgatgaaatatttttgataaagtattgtaaaaaatatcaaaaaagttatatttagaaaatattttgaactaatacaaacaaataggtagatgcagtttaaaattttcctggaaaaagaatctgaagtagtctttgttggaatcccttaataaattattttcaatcacagagcaatttctgacaactttctcgtaaaaatgctttcaaaaactgttcgagggatatctagagaaattctttagttattcctgtataactgacgatcataattagctattggtttgttgaagacaagagataaaagatcaaaaataaaagcaaaaaatgatatgaagaaatattgaacaacatggttatatcttgtaaggccgaatgccgttaggccgaaggctattaggcggaatgcctataggctgaaagggtcgtttggcagaaacgatcattaagccgaaaatggccaatagttcctataaatcgtaaggcgcattatttttagaccgaatggggcagttagtggtaagatcagggtagtttatattatctagatgctgccgaaagaatttttaggtcaaatggtgttttagtttttgggtcaggatagtttgcaatatttagaagcccacaaaaaccgctgtgaaataaaactaaacagaacagcctttgtttaaaagaagtaaaaccacttataaatgtgatggtcaaatgtaatttcggcctaacggccctcctaacggcattcgaccaaatggcattcggactaacggcctgctcccgaacaacatcttgttaagatatcacaagatgaatctaatatatagaaaaattgtagattttaactaaatctagaactttatcatacgccgctttccggaaaaatatgaaacgaaaaaaaaaattgaacctatgatactttttaagtataataggtattatacctataatactatatagtacctataattcttatatatagtagccataaagttttacttttactctatcgataattttcgaaacctgcacacttgggtggtaatcttgactacttcaatgatgtaagattatttcactattattattcaagcaccacggaagatgcactaaacacaaaaagttaagcattcactttacacttgatttcgaatcactactttttttgatccagtttcctcatcgcaagtaatttacgtttttcattattttccatacgtttttacaattctccgactaccatcataaagagaaagtcgttcaaagtcgtggaaaacaaaaagtttaggcatgttataactgagattactactgaatccggaattcaagaatccgaaatactgaaagttctttgtttgctttattaaacacgaagaaaaacatttgtatagtgaaagtgtaccacttatggctataatggttccctatttggccatttgtgttttctcgaaaactttcacattttgaatatttttaaatgttttaacatcaagatgtatttgatgtcaaactacttaaacacacagaacgattaaaaatctgaagataaccaaattaccacgtatggcgaaatagggaaccgttatgtccataactggtacacctaccctattaaagggacatgtttcaaaatccatatcatctgaaaattttgttgatatcctttccaaaaccttttagaaacatatttttgctaatttgtataaattgtagttaaaaatattttcaaaaccattgttttcatgaaaaatattaaaaagctcaattaaaaacactttgaaatttgtaattcattttttttttaatttttcaaaaactgtgaatacaaaaaaaaaaatagtcacctaaaattatcttttcgatgaccgtttaaaaaaaaaattttttctggattctggaattattttgtcaaacctgaaaaaaatctagaaatatcaggaaatttgttttctttgaacgcgtagacaccctgctcaatctcaggatttgaaaacagagatgcttaccattaggctacgccttacagctgaaaaaagaaagaaatcttgtgtacatattttcagatgtcaagctttagctgtcagatttgttgaattttcgaacatcttcagtattaaattgagactaatatgatagtagcccttgagcttacattatataagtttcgatatttgcaaaggaaatgtttcatgctcactgatgtcacctgttggcaaactatagaatcaactagttcgttaatgattgccttataaaaattttgcgaaagacgccaatctgggatatatgcaaaacaaaagtttaaagctcattagcgccgcctgttggtaaaattttgaatcaactagctccacaaaatggtagtccttaacttactgaccaactttacttaccaaccaattttcatccttctaagtggttaagctcctgagatgtctgcaaaacaaaagttccatgcccactagcaccgtgtggtggcaaaaccataaatcaagtagctcgaacaatgatggcttttgagttactgaacaactttgctgaagatgctatctttctaaatgcacaaattcctgagatatttgctatataaaagtaaaagtttcgtacccacctaacgggcaaattccgaattaaatgaggtaccatcagatagcgctccagaacatctttactgaagaccccaagtttcgaaattatttggattttgagatatactgtaaacagaaactgtcgagtattgttcttgagaagattcttgaggaatacattttggttttgtgtcgatagatacctctgttacaaaataatagcatataaatcacaactgttaactgttgtaagtacaacggcgcgacggtccgaaggttaactaattgtagaaaccagctgtagagggcttagatgctcatagcgcagctattcagcaaagccaaactgagggtcgtgggtttgtatcccatcgatcggggatattttcgtaatgcaaattttctcaactttccaaggcatagagtatttttgtacctgccacataatatactcatgcagaagctgttagttagtaactaagaaagtgccgataagataaaagactttatcccaattgggatgtaacaacgccaggaaaaccacttttcgaatggaccactttgagcataatgaagcatgatatacgatttgataagattttcgtcaaatcttcagtttaaagtgaagtttaatctaaatggatgcgaaaatataaaacattttacatgagaaaggactggtttgtttatacgtacattgtatctatgggctctcagagttacagaaatgtagttccgagcctatttttggcacacatataaaatcgacaaaacatcttttcagttctgagactctcacccggagatcaaacgccccgggagaaaggccttttaaaactgtccaaacaacgggtcacggaactcgtcaaatattccctctcgctggccactcctatttcacaccccgctcgatgctgattgagctgacatcttcggtggtgccgtattgcggcaatcgattcgtgacgggtatagcaattatctcacgcccccaacagcgatcacaatgaaaacgccaaaatcaatgagttggaaatcattacgcttcttaattttttcgtagatcgtggacagtgcgggatggagagactccttcttcataccgctgcttgtttctaataatctattagggcggttcaaaattctaaaaaggtttaaaaacatatctctcatatcttgttttctatccttacgataacaatagtgtgatgtgaacttttcagccatttcggtaataatttaaaggtgcctcaaagaccttgtaggtttatatggaaattgcaactgagaaactttgaaaaatgttttaaacaggtttgtattgtaatgttggtgcattattatcatcttatagtaaaaacacattattgcaacttttatttgtttctggtttttttgcagaagtttgctagcctttaatttcataaggagttgaaaaataacaaacaaattcatgaatatctcttctcgcatccattcgactgaattgctgtcctcagcaactttctttatcaaggtttgaagccttcactataagacatctgctcttaattacagtgctatcggttttgaaacatatttcaaaatttctccaccgtaatttcaatataaacctacatcgtctttaggctaattttaaaccactaccgaaaaaatttgaaaatttcacacctttattgtaaggatggtaagaagaaaatggtagattagattttcaaacctttttgaattttgaatcaccctcattccccataccaaccccacaacaaaaaaaaccatactttcgcgcctagcttgtactaaccgattaccctgtcttaacaccagtaactctctgctatcgcacagctctaggcctggcagaccaccgaaacgaggccccgtgggactttcgatgccggcgtcgcacatgtcccatcatgcggcggccgccgccgctgccgcctcccagatcaaaaagcaccggctggacaatggcgagttcgtctacgagaacggacatctcaacggtgagtgtgaaatttcgatactctttgtttcttttgtttcgcctttgtttgggggaaaagtttgatttgggatcgggggaaatgtgacgcacactcacaagtacagcggcctcatcgctaggtcaaatgagttgattggatctgagatttcaattcaaattctcattgagacatagaaattaataaaaattgaaattgaaaatcttgagtacttactgaaaataattcgatatacgttttacaaattttgttacttgaaattcacaactttcgtccatttaaaaacaatcaaaacttccatcaaataatcctactgactgtttctgtttcttttgcgtaggattaaccaatggaaacaagcatgatttctacctaatctcaactggatcctcaggttagttgactgccgtcgaattaataactgaaattgccacttagtgctagttctaaaaaacgcatacattttgtagtgcctaattctgatgatcctattttacgcatttagatattgacatggatattatccttaaaaccgcacgactgaatagtttcgatccaataaaatataaaactattacacaaacatctgaaaagcttaaataaaactaagctaatgtaatattttgaaagattccatcatataacgttcgaaatcaacaatctgtagaattttacggcatccggagagaagatattctaatttttattcgtccgactaaacaaaaatcgacgacattttttggtattgaatgaactaaactagattttctgagatatctgagtttcgaaaaattctccagatagaaacatgaactttcaactttgatttggtaagacggaaaaatctattagggagtcttcaactttttaaatttgtttcgcgattcatatgcttacatacaaaaactatgtttcggcatgttttatcctacaatttacatggtataatgtagatcaatagatttaatccctctgaacgccagatgacaggagaagggacgaagcttccattttaagggctatttgaagtgggaattgagcattaaacataaatacgtttcgtatcagagaaatcataagccatcttccgaatgttacttgttcttgtacgaagctactttacatgaatcgtaaattataccaaaccaccgtatgcaaaaaggatgtccccttatgaacatcgtaaaataaggtaactttgatgaagttttcataagacattctgaatatttctttacacaccctagaaatttatcattgtttaattttaaaacaagcactgtcaactctccttcactcgatattagagaaactatcgacttagatttagaggtacacggtgtcaaaatctcgattattatcgaactttcatgtatctcggatatgtttgcaaaagcgtttagcatttgggctaagattttgtaattggaaagttaaaaaatattttgtcggcgaaaatgtttcaaacattttgtatggaattgttttagctgaaaaattgcctgttctctaattaagtatgaaaaatagcccttgaatgctattttccccggtaaaatgttttaaaattttcagattgttaatgttttgtcgagatacttatctttgtcgaaacaaaatcagagttacatccagcttcgataattatcgaaattttgaccccttgcattgtctctaaaggattctttacaatgtccttttgaatcttgaatatcaagagaaatttgttggtaaagataacgtttggatactttctgaagtttgacttacatatatgatctattcacgttatacacacaagttttccaagtgctaactttttgacacagacaaccagaatgtaggtataataaaatcaccttttgcgttatgcgatgcttatatgggcatagtttcacgtatatgatggtgcgaggccttatgcgtacaaaagtgaaagcgatatacgtgcatgttttatatgatagaaaacaacatgcaatgcgagtgtgtaaattttattgcgagctagtctgtactcttatgcgacttaatttatcataacaaaagttgatttgacagctgctacggattgatccgaccaacctcgtacgagtatacgggacgaaacggaatggacaatcgactaattgatttcgctgcctccaagaatatggtcactcgtagcatctacttccagcacagcctttcataccgatacacctggagatcaccacagcagacagaatcacaaatcgatcacgttcttattgacggacggcacttctccgacattatagacgtccggacctatcgaggcgctaacatcgactctgaccactatctggtgatggtcaaactacaaccaaatctctccgtcgttaacaacgcacggtaccgacgaccgccccggtatgatctaagcaaccagatgtcgcaactgcgtacgcgcagcacctcgaggctgcattacccaaagagggtgagctggatgaaacccctcttgaggactgctggaaaatagtgaaagcaaccatcaactatgcatctgagagcaacgtcgggtacgtggaacggagtcgacgaaacgattggttcgacgaggagtgccaggaggttttggaggagaataatgcagcgcgggcggtcatgctgccgtaagggacccgacagaacgtggaacgttatagacgaaaacggaaacagcagacccgcctctttcgggagaagaaactcctggaggatacgtagtgtgaggagatggaacagctgtgccggtctcaagaaacgcgtaagttctatcagaagctcaacgcatcccgcaacggcttcgtgctgcgagccgagatgtgcagggataaggatgggagcattttgacggatgagcgtgaggtgatcgaaaggtggaagcagcacttcggcgaacacctgaatggcgcttaaagcacaggcaatgaaggtcaggacaacgaaggaaatgccttcgtcggtactgcggaggatgggaaccaaccagcccccactttgagggaggttatgaatgctatttaccagctcaagaaaaataaagctgctggtaaggatggtatcggagcttaactcataaagatgggcccggagaggctggccatttgtctgcaccggctgataggcacaatctgggaaacagatccggaggattggaaggaaggggtaatatgccccatctacaagaaaggcgacaagtcagattgtgaaaactttcgagcgatcaccattctaaatgcggcctacaaagtacagtgacctcacgcagttgaatcacccacaatttatgaatcagctgacttcaaaagacaaaattattatcaaacttgtcacaaaacacatagtttcttatcatcagtaaaaataattctgtgaagttttgtgacaagtttgataacaaatttgtcttttgaagtcagctgattcataaattgtgggtgattcaaatgcgtggagtgactgtattatcccagatcatcttccgtcgtttgtcaccttatagtaagcgagttcgtaggaagttatcaagccggcttcgttgacgtccgatcgacaacggaccagatctttactgtacggcaaatcctccaatgtggtgaataccaggtcccattgcatcaccttttcatcgattttaaggcggcatacggatatcgaccgcgtagagctatggaaaatcatggacggaacagccgtgaagctcacgaggctgataagagcaatgatgggaggtgtgcaaaactgtgttcaggcgaacacaccagtttgtttggatcccgccggggactacgagaaggtgatggactttagtgcctgttgttcaatattgcgctagaaggtgttttgcggagagccgggcttaacagccgggatacgatttttacgagatctattcaatttgtctgctttgcggatgatatggacattgtcggccgaacatttgaaaaggtggcagatctgttcacacgcctgaaacgcgaggcagcaaaagttggactggtggtgaatgtgaccaagacaaagtacatgcaagccgatggggccgaccgtgacagggctcgcctagatagcagtgtcacgatagacggggatacgttcgaggtggtggacgagttcgtctgccttgaatccttgctgacggctgacaataacggttgccgtgaaatacggaggctcatcattggtggaagtcgggcctactatgacctccagaagaagctgcggtcaaaaaagattcacgcccgcaccaaatgtaccatgtacaaaacgctcataaggccggtagtcctctacgggcatgaaacgtggacgatgctcgaggaggacctgcaagcacttggagtcttcgaacgtcgggacgatcttcggtggtgtgcagaagaacggtgtgtggcggcgaaggatgaaccacgagctcgcccaactctacggcgaacccagtatccagaaggtggccaaagctggaaggatacgatgggcagggcatgttgcaagaatgccggacagcaaccctacaaagatggtattcgcttcggatccggttggtacaagaaggcgtggagagctgcgagctaggtgggcggatcaagtgcgtatcgatttggcgagcgtggggcagaaccgaggatggagagatgcggccacgaaccgagtattgtggcgtgaaattgttgattcagtgttatctgtgtagatgttaactaaataaatgaaaaaaaaatgaattaaatgaatgaaattctaaaagtcgttactaacttaaaatggaatggtctacaactttgctgaagcttgtataccatattttttacaaataagatagttatttaaatcatttctatggaaatgtagatcagccatattttcaatttcaataacacctaacaaatggccttaacaatacaaacaactttgtaaaaaactgttttcgcctaaagtgtcattctaggcagtgacaaaaaaaatatgctcactttaataaaatcattaacatttatctatgttaccatcaaagtaaccacgactaatgtgattgaaccaatgaagatggcacaaaactagacaaagaaaacaaacaactatggccgtttgttgttagtgtttgtgatcttcacaagcagaaaagtgacagtcttagaaaactgaggatcaataaggttcctgtgatttaaaatatatgctgtgatacgggaaataaacatcggatgcacggaatcgatcatattgacgcgtcttcactgtacttggtacaaaaattacaacttgcaaaatgcaaaaaagtcattatggcttatgaaactcatattttcgttactgagtatcacggatggttgagtatcagcgggataaaaggaaactgacaatcttgtggcaagcgtttgccattctgcgttatgttgacaagttggatgataatcaaggaagattctacccagcaaatgtcatataggcgagagtagattgataatttcgttcctgattctatttaaagcctgatttgctgcccaatggtaatttcttggcctatctttataaatggaaaattccggcaaggaatcgatcaggaaagcagtttttttttctgattgcagtacgaagttgaaaagaaatgtcagtccaaacgggagtcgcttaagaacacttctgtaaggaatcggcgagaagcttctttatcgattccttttaagcaggtgaagatgtaccctagccgaacatcaaattttcaagatcacaaatctggagaagcaagcatccgtttaagctgaaaactagatcgattggtctctagctgaaggtgaccaatcgattttcaggccaaactgttgttcggttctccagatttgtgccattcaaaatttggagtttggcttctattcatcttaaccttaccactgaaccactgtgcagtggttcccaacttttttgaagcaacgagtttgaagttcttcaaacatctttcgaagccctgaaaatgaaagttgaaagttgaaatataatttagtggaagctctccaaagatctcattacaaatctaagatatttttggaaggtcacctaaaagtcatttctgtaattcatcacagataatgcattaactttgctgagatgatctggacccactatgtccgctgagaatctcgcagaagtcctccaaacagctttccaagcaaattttgaaaaggattttaccgaaatctgaaaacaatctgatagttaaaatgtcaacgatttgtcaaaggtattctttgagaaataactccaagattttcataatgtttgacagatttattccaacgcttctaccagaatccacgaagttatatgctaatagattcgagaagttttttgatgttttaatgggttgagtgggaacagtcgagaattttgaattttctcaaatcccgtcaatagtcacagagttttgaaaattagaggatcttttcagaaagctgacaaaatcttacaaggattaaatcaaagacatgccaggaatttcgtaaggcacctcgagtcagtgttgaaaatcattcgaatattacttaatgatcattttgacataaatgaatccgtcatagaaccctcaaataaccggtcaaaacctaatgtcttatttacatcacaaaggtttgttgttattctacaagacaaacaaaaaacaactgcctttgcgagaaaattactggaaaacatgacaatgagtcaaacgtacgaaccaactcatcaatgattcaaggactctggagttgcgcgaataatctctagcatgagatataaaagttagagattatttcaactatttttttaggaacgatggtatgatagaaaaaaaacatgctaagccggtgtggttaaatatgcttgtaatctctgtcagtaatagtcttgaataaaataaacaaataattttgaactgatctgcaattccaaaaatctgaaccaagcataaaatgatctattgctgagcaagatagcaagtgagtcctcacatttattcagcaatcaagaaaaagacatttatctgcaatggatttttggaccccctggaaatccgcacgggaggggggtggggggttccgcggactactagttgggaagccctgttttatgccaattgcccattgcacggtaacgtcatcagaaaatcgctctctttcccttttccctccttcgggaaatctgaaaacaacgttgccagtacctgtcaacgttgacaggtactggcaccattgtttttatgttttgttgaagagcgaaagagagagaatttcgccgtgaagtgcctaattacttttgaactcctataccgttttgtctaaaattccgaacagactcatatttcaaacactctgcatggcgatcttgatgaaacgtttcactgaaataagttgttcattttgcgggaaatgggaatccatttcaaatttagagctatcagagccgattttaagtgtcctgttttgaagtaaacaaaacagacaccagaatcaaaaccaaaacagccacaatttgtttgtttagacttccaaatcgattgcgagcaaccgattttcgataaggcacacatcgaccgaacgagacgacggagcatatcgcgtgtttgtatccaaattgattcggacgtttcccgttccgcaccaccgcgctcgaaagccaccgaacatttcgccaaaaatccatccatgcattgcagaccttttacgcgatatgtccattgtaaatttatgcgtggcatacttataatttacataatcgcagaatctagatccaaaataggcagtgcccaatcgattgatcttgaactatgcgtttgcgtacagcgttctctgcctttattgggccgtggctatcaaaagcgtttagcaggtctgcattcgcctcccagccgaaaaggtatttatgctaatcgcgtcaaataaatggcaggtctgggtctctggatggatgacccaccagctacattctttcgaaaattcatattgatcaaaaatgcagctcgccagacaccaggaagatattcgctccaaacatggaaattagatgaatttagacaacctggatgcccgagcagatttttacgaccccttagcatacgcgccagccagatattcgggaaaagacctgcaaacgcattcgggcaataaaggaaacataataataaataacagctgaaatcgtttaaaatgattatatgggatggaaatgcagcttaattcgtcgagttggtacaagggaagggacgggaggctttgcaagcggcggagaagataaggattccaaagtaaaagccatacatgcattcattcttcgccgttgctccaatggatgttggctggaagaaaagtgcggaaaagtatgtttgggctcagcgtttctgttgtgtgcactaatcgactggtttgatattgggcagagcttggccgaggtcagcatcggagtctgagtcgttgccttggagtcccttcggtagtgggaggccaacactcggatcgacacggaatgctaattgtttgattgcatttaacattcttgcgatgctttcggtgagatatgcaatcgcaacattttttatgggttttattgcggatattgacactttagacgtggaacgcttttgtttgagaaacgtaaaggagcatttctcgtatcttggaatatttctgccttttgatgtattagaattgaatcttgaccaaaataatctaagcatgcaattagtacaccattagagtgttttaaattacaaaaaaaagtttgaaaatctcatctcttatctataaatgatggaaatacagtggtgcaaaattttcatctattaagatggagattcaaagattgcctgaaggcggtgctgacttatacgtatattactatgaggacattaaatcaattcgacggataggtgaacttttgggatttgaattcgaaacttgtaaccttctgagttattgagtcatcatgtggctcggttgcttagttagtaaagctcccgtctagcttacaagagtcagtggttcgaatcccatctgagcgcgtggatttttttcttcatgaattcactcaaaattgatccatctttactacgcgtaataaaaactttattattatcacaaagattttataaaaaatatgtgagaaaagattataaacttttttgttatttaaaccgccctaatatgctaaccatcaattgatattccccacagtgctctgtggtcaaataatctcgcagctcaacgtacatcatacggcatcaacctcaattaatcgacgatttgtgtgtgtgatttacagatatctcccggctggacaagtcacccctgctggccaatggatacaacgctcccccgacgcatttgaatcacattccgttcatgcaaatgaatcctcatccgggcggtggccacccgctgatgagccccggtgtgaacgcgcacggaatcccacggccagatgggtcaattatcaagggacagaacatccccggcatggaggctattgcgaggtgagaatcgaaccctttccatttgtccatattgggtggcgaaattttcactcaataaattcggtccccttctcattcaattcgcagagctgcgtatgaggacatcgtcaagcatttggagcgattacgcgaagagcggggtgacgacaggacagcagccctcgatcaaaaaccacgagatctcagttcccagagtggtacgtatgcagtattgagttcagttaattgtgcgacatttttccgagaaccattacgccgatttttctttcgtagcgtaatattttttgatgtaatgaactgccgtgaatcgcaagtcagtcccatctgtaaaaagtaggcattgagaaaatgggctgtgaagtttctgaactcgctttctatacgaatattcaaaaatttctagaaaattggaacattttcaaatctcaatgaaactttcacaatttgcttatcactatgatatctttccaataataaagacgcttcatttttgggttacacggtgcaaaaatctgtagtgagactgatatgcggttacttttcatgatgggacaatttaacttggtgtttctttcgtaattttctgagcaaaatatattatttcattagtgcagctgaaagagcattggaagatatgttaaaaactgaactcaactcaattttgacgaaaatgcagatgggactgacttcttattcacggcagtgaagtacttgatggaattcatcgttttatcgaatgaaatggtcttcggtaaaacggttcattccgcgaaaagtcacactgcgaaaaaaaattcgatgaaatgatatacaaccagttcaatttgatctttgccccaactaatcccccatcttcccgcagcacctccgccagattcgccaaacggtgccagcccggtgctgaatttgtccaaatccggcggcgatcagaccagtggtggcgcccccagtgagcgaagcaatcaaaactcgcccgagccttcggtgcacgaagaggacgaaaacatcagcgaagccaacatatcggacaccgaggaacccaacgagaaggaagaaggtaaagttgcgctgcacgcgaacacaaaaggtcaatgatcaacacaactcgcattcgtcgtcattgcgatcaaacgatcgtttattttctggccttgcgcgaacgagaatgcatgtcattgtaatcggtatcatgcaaccgactgactgcactttctttttcatttttttcttccccgcaaacagacatcagcgactgcgagagggacatttcgtcacctgttccggcgacagttccggtttcgcaggacatggaaagccgtcagcaggcgctgaactactcgagtttggcggcgacggcggctgcagtggctgttggcaatgtaccgacggctcaggatccaacgctctcgtcgacggagacgctgctgcggaacatccaaggcttgctgaaggtggcggccgataatgcacggcagcaggagcggcagaccacttatgagaagggtgagttttattggcgtggaagattttgggtggcggaaagatgaatgcaaagaatattgaaaagaaagaatgatgattcatatatatatgaaaattcattttttgtaaatgaacggttcgaatcccgacatggacattcgactactcatcaactttttcgtataataaatttgatttgttctaataaatctgaatgctattctactggtcttacccttctggacatataaaagcatgattttccaacatacattgttagaaaaatccaaagttatctgtcaaaccgtacatttcaagtttattatcagaactccaagtctgaaagacttcctgtaagagcttgtgttcctcaagatagcattttggggccaatgttatacaatattttcacatctgtgttttctaacacttgaacatctagatatatgaaatgaatataatgtttggaatgatataaataacaaataaaacaaataatattgtggagatcaatatgaaggagagtaagagaagaaggaagtaggagaaaggttttttcctcaatatgaaatttcatatttcatgaaaatttatctaatatcgagacaataatttttgtcatgaatttaatttttatctttagaatattcttgagatgttgtatatgcatgtttcaaacattcatgtctaaatttaagaatcaagcttagtaatagcaaatattgatctggatagctaaaagatatattaacttgacagatataggagataaaagatctggaaataatatcttaaatttatttctggagtagcattggcatatcatttttagcattcgtatgactgcaagctattcattcgatttgcaaacatcatattttgctatagctcagaagttccaagaccattgtacaaagcacttcacaactcttctctattagggtcgtagggaattgattcccagcaagaaatggcctttctttccgcgactggctcaatttaatgcatttttccactacactgcactaatcgacggggatcttgaccaaagaattacaacaaaattgtagcacagttataccaaaatatgttacatagggtaggtgtaccagttatggccatagtggtttcctatttcgccatacatgataacttgaatttattaacattttgaaaaattgtgtgtgttttaggagtaagataaaggatatatcttgatgttaaaacgttcaaaaatataaaaaatgtgaaagttttagaaattacacatatggccaaatagggaaccactatggccataactggtacactttccctataacaaattttgttcaatttttgttagaagcactgtgagttgataaacgaaattataacataactgtaacataaattgttatatataaattaaagaaattgcttatcacaaatgttgatataattcagttaaggaaaacaacaaaatgagttatatttttgtttgtttggaactcattatttacgtttttgtttaaattataacatattttgtttcaattttgtttactgtacaggaagttttgttattgctgtgtgcgtttgaaatgcaaatatcaaatgcgggaacaccaatcgtggtataatttttaacaaggaaggcgaagtcaaagattggttttctttgctaggttggcggtgatattgatcatggttgctaagtatcctttggtttcttcgtgttacctcatttgaagcccagttgaactggatttgcacgtcaaacgcaaacagttattttaactactaaccaactaaaattataacattttatgttagaaaaaatgcgctagctgagtaacgaaaaaatccatatgttaaaaatctgtttcaattcactagtcgcgatacttaatgattaagcggtatgctaacattatttacaagtggaaattacattttaaatttacgttagtttaaaacaaccataattttgatgttatcttcagatcttcaatatcaatatcaagtttgattgtcaatatcacgtttgatattgagttaatatcacgttttgattatcagatctccccttccacttggttaggcatacaatctcttgtgtttgaaatatctaaccagcattatgataaatacgatcgttaaggctgaggagacgacttcgtgaacgagtgttcgacaacggaccaaatatttgcgttgtgctgagcaataatgttgaactggcatttactttgcatagttacattgttaacgaactttgaaaaaacgtgtttgaagtctaaatcagggctttctaacgtatgttccgccggccgcatccagcccgcagatttactttgtgtaaccagtgaagagtttgaagaccatatctatagaccatagagttttacagagttatagaccaagatcatatctggcgcgtcaattgctcgaccaacgtagagtgaaattctatggctatttttaacttaagattaaattttaatctgaaagttgatgattcattatttttattttttatttaatttgacttattttcaaaaacaaataaaattaaactttaaataattttagttggccttgggaaatcacaaatcacaggggcgaatcacagaaacaattttgtgtcatgggccacatttaaaaaataaaacacagcgattcgcataaagtctgacaaaagttaataatgaagctcataaaagctgacacaaatgaagtaaatttcatgtaaagaaattgaaaaacagagaattcctgctaaacattctgctagatattgtgagggtttctttgaaaactgcagaatatttggaagaatctaccctaaaatgtttggattctgtgcgaataattctcaagattatataaaaatcatactccgaattatgttagaatccgacccgaaatgtgctagaatcctggtcaagcttttacgaaaattttcggcagaatttccaggattttacaagaatcatgcctaggactgctttagaatctcacttaaaaaacatttcgaaatgcaaccttgaaatctttgagagtgctaataagtatttcataagaaagctaatcagaattgtattataatgtcgcttaaggttctaccaaaatgttttgcagaaatatgaattgaattcgttgaaaatccaggaagtctatggaattctggtgaaagttctctgaaaaccttgtcaatgttatccgtgaaagctgtgtccagaattgttaaaaaaatcctgtttaagattctgattctgattccaggaatctgcgtgaataactcccaggtgttggtagtttttttttccaggattgtgtgagaatataagcttatgattcagtgaaattatgtatgaaaacttagcgttttgtccataagttttgtttgtgccacattttttaatgccgaaggatgtcatggttgaaacattgttgaaacacacagaatttgagattattaatttgaatcattcataaaataatgaagctaaggagacttaaaggaaataaaacaatttaaataaaatattagtttaaaactaaattggaaattaaaaagatttggtatgttcaaattggttgagttgttcctaagaaaattaaaaaaatttgtagttttgacgtttttaaggtacgaccaaagtggcaccagacacatgaatgtttattacttgagaacagtagcaacaattgtcttcattcttttcaaggtaggttctcatcaaagtattgttttgtaaagcgattaactgagcataaacgaactatgcagctgaagattattacgcattaatcccgcatagatttatggaatttctaagtaaccagatgaccagtgaccaaaatccacatacattctaaaaatagaaaagcgacatatgattgattttaacaagctcactctctagagcctattttatactcctcatattactctccttaatgaagtgagtactcacagatacaaacgtaacttgaaaagtaccgatcggtactcggaagttattcgattcttctgtctagagtcgaagattacatacatttgatttaagcagatcactaatgaatccaaagataagaaaaataagttgtggaaatgtgttcttcaaattatgccaaatgaccgttatgccaaatgacattatgccgaaaagttttttggtccaagtatgttcatagtgacaaaaaaatttgatatttgtttctaaaatataaagaatttacctagatttaatatgtcggtcatgtatgacgtaacagacgtgacagaaaaaattgatttatcgtcaagcttcaacgaatgttgttgataaaaaacctaaaaacccaatcttcctgaatcttggaaagaatttgcaaataatatttagcaggattctatagcctagcaaggattaccacctaattcagagtttaatttcaagtcgtgagcagggtttttgcattatcctagctgattttctgaaaaaaatctcagcgtggttttaatgaaatttacattattttcaagagtacatcgttccagagtaaacacttctattaacccctctaccagcagcttcattttttaccgcaaaattcaaattcaaatcgttatagggtaagtgttcccttagttgtgggtgttcctatagttgcggtagtgccgttttcactgattttattgcattagccacataaccgacactgctaatcgacgttttggcttgttgacacacggaatagttgaaaagagcgttcaatttgctttaaaactgatgaaacatcattaaaattactaaaacttttctcacttgtaccaatagttgcggtaaagtgttcctatagtggaggatcccataagaaaacaacggataccgcaactataggaacacaaattaaaaatataccgcaactaaaggaacagtgtaccaatagtggaggtattagttttcactgacatgccgtggattactgcaatgaaatcaattttctcattaagtcaatggttgttacttcccgttacaacgttaacatgcacattaattgcacttcttgaatttaggcggttaaacgaagttcaaccgtgcttagtacctccactattggtacatctaccctaactattttgtttttcaatattttttcaccattttttcacaagttctcaaaaaactcttctagttttaggatctgtgttgatattgatcattggtcatctgattttgaagatattccaaaattccttgggggaccgacccataactagaaccccccattaatttctcaggctacagaattttaatcgtattcggatgttcattattcggaactatacattaatgagagtaaggtttctggaaccacgctggccaaataaagatcttaaaaacttcaaaacgatcatatcgtaattttcagatatctccaagaatactgaaccgatttgtgtgattttgtcagagtagctccttattacctggcattatatagtccatgttttatttttttgattaatttattaaaaaacaaaatggccgtcaaagacattttatatggaaaatgtcgatcccccaaggaacatctaaatatctttgaaactagatcaccaataattaatatcgacacggattcctaaactagaagagatgtttaagaactagtgaaaaaattgtgtaaaaatattgaaaaaaaaagttataacgatttgaatatttattttgtggtaaaaaatgaagctacctgtagaggatttaagatattcctggaatatcaggataagatctttatattttaattgataggatatgtcaaagttagagtttttaagaaaaaatggagaattcagaccaaacacaacccagtaaacacaccatcgtatatgatggaatataagagtacagatgtggaggcgatatacgtacatcttgcacagagccttatggcgcatgtgcgtatatcgcctccacatttgtactcttatgcgctatcgtataggagtttgtgtttactgggaaggtacacattgaatacaatttactgcataatcgtaatatttcatacagatctttatacactgtccgaaagcttattcaaaaagctttcttacaaaaataaaatgaaataaaaattcgtattttgggtcggaaaaatgctgggagtgtactgaaaaaatatatttgattttatatcgaaactttacacatcccatacttttttgtcccaagttgtcccaggctaaaatttatttccaagggtactttgagatgtaaactgaagatcgtgaagaatttagctgcacaaatttgcactttttcaatttagggtttgttgaatttttacaattttttcaaccattttttattgaaaatagcttaaaagttagtcagagaataactgaatatcgctaaatcatgtatatcatcatttctatgtaaggtctaacatttataatggtttgcacaacgtttatcgcattaatggcttatatgcataattagtaacaaaacgtattatttcgctatagatcctattcaaaagttagtctcgaaaactttgaaaataaaacatcaaatttgtatcacaaaactcataaatacgacatgagatggaaaaaaacatttttggccgccagtctgtatggaaaccgcccatagtgcggtcttgagttgcaaatgtttggtttaggtacgataggcaaacagtttcaacactaaataaatcgcactcgctctttccgtgtgagtagtataatgagatggatggaaatggtttatgaagggggtccgcgtggtctgtagggatttgaattctaaacttgtaacctacccgactaagggtacataacaaaattatatcagcatatgttattatgttataagtttttttcgaacataggttgttacaaacttgatgcaggttgttgttaaaataactaaaattataataaaaagtgtatgaatagcaacataaacataacaaaatgtgttttaattctaacaaaaacctatcaaaccaagttataatgtttgatacaaagtaatattgtatattattgaaatgcataactatctatttattttgttataaagttgtcaaaaatgaacaaaaaaatatcttaaagggaaataaaacacattatgttatatttctgttttattatgttctatggataacagagcctaacaaaattatatcataatatgatatggatatcatattctgatacatttttattatatttttgttacaagcctctagtcgggaactcagttattgggtcatcaagtggctcggtagcttagttggtaaagcgctcgtctagcatacaagagtcctgggttcaaatcccagccgagcacgtggatttttttcataatttcacccataatttgtccatctttaccacgcgtaatgagttaattaatttaattaattcctttaatcctgtttcatataataacacagcgtaacaaaaatgacatttttgcgtgtatcaaggagcaaattatgtgtcgttttcagaaatgttccagcacatcacaatttttagctacagttcgccaaagttgtatgaaacactggtttcattgatgtttacataaaatttaaagtatgatttatcaaaatgtattgtgatctaatccaccaagcatgcaaaataagacttcaactttcttttcagatataatttggttgaaattgcattattaaatttagattaaatcgattttatcaacatgcttgctttcccatataaaattctttgtttctcttatatgacaaaatacaatacttttctaaactatcaaaaactaacctttgagcatcgaaggcttatgagctttgttgatacaaaccatacaaactagaaaacttgcatgcaatttgactgaaatagtcaattttcgcattttcaacagtcaatatttcaaaaacaagacgtgctatgatgtttttgaaaagtacgtgttccgcagtgtaataatatacacatacctggtgataaattcgataatattctgacaatggttcgagtaaaaataacgtaaaattttgagcttcttcaatcccgtcgaggcatttcaagaccttccgaagcattttgttatatatttaggaacgactttagatccatttcagattcccaatgaaagattagacgtataatactgggcttgtgatctcttactattacatgacaagtttttaatcagttattgtgtaaataaaaaaaccaatcatattttcaaattattttttaatcaatctgccccctactcattacgagaagttacacacatttatatgtttataattaaaatggcttcgtcttaattctattgatggatgagaaggctcactttttcgcataaaataaaacataacttgagctggttttcaatcagaagtaaaatttgaaattggtcaataacgagtttcagacatcaaaccactagatttagcgaaacacctccagtcaaataaactccaatatgatcatatcatcatcaaatcaaaccaaggctgtgggaataatccaccctagactttcttcagtcacgtcgggaaaaggtgtcactaaggtgataaacgatctaataacagaccatcatctcatcctcggaaatacctgatcttagcaggaatcgatcattgccaatcaaaaccactttgtttaataaaagagtggagaagaaacccctgataaatttcccaaatcgatcaatcgcgttgcggtgcaccgtttgcaagcccgatcttagaatcaccacatgccgaaatcgcagccaaatataatcgaaaaatggtaaatgataggttaatcgaactaaacattgcttttacggaatagtagggaccccattctaaagcatgatcattatgcattccttccccgtatttgggggtctctgggtctctctctccccggcgcgacgacgtctggcccattcccaatccgttgcaatgttgcgactttggcgatgattttgtctgccgatcgccaaaagacgcattccttagcgcggtgtgcgcgcgaatttaaatcgagaaatgatagccgaaaagtgcaagcgacgaacccgatcagtcagtcaaggcaagtcactcactcacttcgactgttcgactcggatcgctgtatttgcggcggcagaaccggccgctcgatcgaaaagaaatacacagaaaaaactgcaaaatcgataaaaattatctttaattatgggcccataaagtgaaaacgtttatctacgtttatattaattcattttttttttctcgctgtccctttcgatgggctggatcttgttcctgacgagttgcgagatcctgtggttagatagcgctctgttcactcgcagaaacatttcctcggctcgtcttctttcgagggggggtgccattcggtgatgcgaccgtcgtcgttcgcagatggatggattgcacacgattcgctcaatttttctgcttagtttttattaaataatgtcagaatcggaactgccagacctccagttttggggagtcgagccgagaatgagtgaaacagataagggaggaaaaaatcaaaataaaaatatagccactcaatttaacacgctcgaagcaatattgaacgaattttctgtgctcagacagaggaaaatgaatcgaaattgttgtaatcgacggagtggggagagaaaaaaaaggcgctcgagatggaaaataaaactatagatcaccgtcgagaagcaaaccgtctggatttggagctgattcgggggtgcagatctctgtttttttttttgtttcgatgtgcgacgaataatagctggaggaaaatgtagagctcggaattacgattaacgatacatattagacggtgtggtgttcggtgtctgtctggaatcggatcatatgtgatgaagtttttcgtcaattcgcctcgggttgattagatgcagaaatgtcgatttggggggaggcggggatgtggggaacgaattatttccatttttgaaggcggtggaatttgattggtaaaatggagaaacgattaggcaaggagatacagtcagccatgaagaaagatctttatactaaagcgtaaaaaataaatccaaatggatgaagctgatcagttgaatagaataataacgtttttttatgttcagcaataaacacttttcaatggaataaatcaaattggctatgcactttgttctgatacgcagtggaaattactcaaactgttgttatagcttgtacaaaaaaaatgaagatttaggcaggagatcacgaactccattggggaaataaaggtttccttccaaatcgcaaagaaaggaggctgaggggtttcatcggaaacttccaaagatcgagaacttcttttcaaacatcttgaagagaagcagcacatttttaacttatgataacagaactgaacgttcgattaaggtcgtcttgaaggtctctcaagagaatagagaggagttaaacaattgaatatattatttacttggattttttccaatacttggactccttatgcaaaagagaatccaatccaacattcgtcggaaagggctatctcaataatattgtttagttcacttaaataaagtgttttgaatagaattgctcgttttctgaatggtgaatcattaatatagaagatagaagttgctatcatcatttttaggcgtatataccaccaacttttttgtcgtttgaaaccaaagtttttgaaactttgggtgtttttttgttgaaacacaggttggttaaattttttcataactgctaatacgcctcaatgcaactgagcacgaagatagtttgcttcaaattgactagcgaaaattgattcgcaataagtcaaaatattttgtcattggtgactttaaggacaaacatcgctcatggaagaattcgcaatgcaattcaaacgacagaaatctatttgaagagtgctcttcaggatacttctcaattcaataccctgataaccctacatgtttttcctcttctagaaatccttcttacgcttgatttggtcttaaccgactctagtcacctttgtagccaactggttactcacgttgattaaaaaaaattctattcgagaaaaaagcctgatctgaaacgatttataaatataatgtatatgttcaattgtattcatcattccgcacttcatcgacttgtttcggtaccagtcaattctcatcttccctttctctaatttactcagtcataattaatattaatcaaacttgaccacttttgttccattattctgtgttcccctttccacacaaaacggcgcaatcccacaattttccgcaacaaccgtgtgcagccgaactgaagatggacgtaattcgagagcgcgaagtcaaagattccctggaacgccagttggccgacgaaaagcgactccgaggtaagggctttatgcttgattattattatatatcttttttcaatctgctcgacgaaaccatcaactgttcccacttcccgtcttcactctccgctgcagctcacttgctgagttggacgaatgcgttctcgtatttatatatcttttaaattggattagcaaattataccttgaagaaagcgcaccggagacgaagatagcccggatttacttttccgggttttttcgttatgagctttgagcgtgagtcggacccgggagaggaattatttataaatgattgatgaaattcgtcaaacgatttagcgtcataaatcacaataaagtcgatttcggaggaacccggcagaattggcgcagtttcgtcgttgtctactcgattaaattgcgaatttagacacaatccccagaagaccgacaaaaatgggcttacgttctgttttcttccgttatcctgcagggctttatcagaaacgattcaagaaagagcggcgattgcgagttcagctgaaagagcgattagatgccgagcggaaacgtcgcacccagctggaagagattatcaaagcctccggagcaccagccgaagcgttgcggattatcgcaggtaagtgggaaaccgaaatccgcggaacgtgattttatgattgacttccttcttcccggtatcactagaaaacatcaacaacgaccagcagcgggagaaggagcgggaacgggaagcggaaagagagcgggagaaggagcgcgagaaggaacgcgaacgggagaagggacgtgacgatcgggaacggagcgattcggaccgaatgcgagatcgggactccgatagggagcggagtcgagagcgacacgaacgggatcgggaccgcgagaggggttcctcggtggagcggttttccaaggaaggcagtccggtggcttcccgaggggccagtcaggaggtttcgccaccgcagccgcaggtgcccgaggggaaaccgtggaactatccggggctggacatcatggcgaccggggcgttctggcagaactattccggtaagtggaagaacttgaataataattcttaaccttagtaaagaccttgggtctttttcgactcttttcaaaattcaaatcaatgtaattttttattgaaataacctagcaatttaaaattttctgacaattattttttggttggaaattctatttttgcggaaaaaaaagttttgaatgatctttaggggagctaaaacaataaaaaagttgcaaattgtgacgaccctaagtccacccgaaaattcaaagagcttgcaaaaatcagtgtgttgaccgatttagttctcttggatgctataacttattggtcccatattacggggaaaccctgtggcctttcgatgaatgaaaaaacgtaaagaataagacacaattcattttgttttggggtataaatctgagtagtttcatcaaattctccaaattggctaccttcggagactccaggaaccggttccgcatggaccacactggaccgaatttttcaggggatgtgaactggcaattagttccttattacagagaaattttatgccaaaatatccatcaaccgcaaagtaccgatgtgaattaatacataggcatccaaaacagcgatggaaacttacttttcggatgttcggtgtttctggaaccggttatgaataactaactgaatctttattcacagtccacgtgagtctctaaaaagtctctaaggggacttctttcagatgtagcaggtccccctttctattaggacactaaggaaggttaatctctcttagcgttggagcctgcatatagagtgcttcgtgaagcccaagcaggacagttcggttttgtgtcgtccgatagatatggctcacggtttcgcgcgtgttttcgtcgctggagattttttttcctgtttcggagcgtcttgctggttagtgcttcgtgaagcccaagcaggacggttcggttttgcgtcgtcggatggattttgctcacggtttcgcgcgtgttttcgtcttcgaggaatttgtttttcttttttggagcgtcttgctgggtaggtatttgggaaggcacaagcaagacaatttgttgtcgggacgccaagaagttttgctgtctgtgtcagttttgtgttcagtcgaggatggattaccaactggtgagttcgtttcatgcttgtgataacacattttttcttgaaagcgtaacttttaagtaatattaaaacaaactttgtatggttcgtcactataagtgtcggcattatgtttttttcttatacaatttcaatatacatatatttgtctcttttatatattattaaaaattatcttttgaattgttcgacattgtgaatgttgacgtattttttaaaacttctaccatatcgagacaaaatgcacagtaatactcatatgtaattttcaaacaaactatgtatagttcgtcactacaagtgtcggcattattcctgtttcatataatttaaaatatatacatgtaattttcagttttcgtcattaataaaaacatcttatgaattgttcgacattatagatgttgacgtattttctaaagcttctaccaaaaacttctcgagacaaaaatacaaaactagctttaaatataagtcgtatatttcccccttgtccatggatcgcatcatcgaccagaggtgactcccagatcttttcctccctcactaataaacacccttcccgtggtgattgtggagatgcagaggtattctcggtctctagaagcaacaatcattacaacctaacattccttccccatcccaactgactgtaaggacttggccggcgccgttattgatcaataatattagatctgctaaaattgcacttcgagagtaagcggaaactcccatcccttattcatttggatcgtagtgcaattcttaccagttccgatcaatcacggagtagcaaccattgacatgtacagtcagtctatgctatgctatgctatgctatgctagcgttggagcctgcatataaacagttaattatgatacatcttcataagaatcaacaattgcatgtaataagcgtgaaagtgcttattgaacactaagctgagaagcaagcactgtcccagtaaggacgtaatgccaaaaagaagaaacagatgtaattagaaacattcaaaaccggattctgatttgaacatttttttaatttactaaacatcaacgttaacgcgttcaggagagtgtagatacagtgagaggcaaaataaagtgcccaccttaccagttttcgaatttctctcattgatttggttcaaattaaagttaacacacctaaatcttttgtgatattttatttttgatgttcttttaaagttgcacttacgaaattttgataaaaaaaagaattttacttaaagaaaaagaaaatcaatttgtattgaaaaaaagtagtgacaaaaataagtgcccacttccttcttggccccagaaaagatgatttaagaaaaataaaaagcaatttaatagttaatgtgtcctcctttggccttaaggacttgctggaggctcttcggcatgcttttcaccaggttttgtaggtgttgtggatctagttcttcccaggcgcgctccaaggcttcaaaataattatttttgttggtaacaccagttttttcaaccctggcatcgagaatcgcccacaaattctcgatggggttgaggtctgggctttgtggaggccattccagcggtttaatccgacaagaccggaaaaaagacttggtcttctttccagtatgcttcgggtcgttgttctagagaaatatgaatttctcttcaaggcccgtctggatcagcgaaacctccagattttccagcaagatgttaatgtaggaatctgccatcattattccgtcgattttcacgaggttttctactccactccatgaaaaacacccccagaccatcacatttcctcctccatgcttcaccgttccttggatgtggtgctctgcatcacacacgagcccgccgctctcggttagacagctcgagcttcaggagcgccacatccaaggaacggtgacgcatggaagtgtgatgtgatgaaatgtgatggtctgggggtgtttttcatggagtggagtaggaagcgtcgtgaaaatcgacggaataatgacggcagattcctacattaacatcttgctggaaaatctggaggtttcgctgatccagacgggccttgaagagaaattcatatttctctagaacaacgacccgaagcatactggaaagaagaccaagtctttcttccggtcttgtcggattaaaccgctggaatggcctccacaaagcccagacctcaaccccatcgagaatttgtgggcgattctcgatgctagggttgaaaaaactggtgttaccaacaaaaataattattttgaagccttggagcgcgcctgggaagaactagatccacaacacctacaaaacctggtgaaaagcatgccgaagagcctccagcaagtccttaaggccaaaggaggacacattaactattaaattgctttttatttttcttaaatcatcttttctggggccaagaaggaagtgggcacttatttttgtcactacttttttttcaatacaaattgattttctttttctttaagtaaaattctttttttaatcaaaatttcgtaagtgcaactttaaaagaacatcaaaaataaaatatcacaaaagatttaggtgtgttaactttaatttgaaccaaatcaatgagagaaattcgaaaactggtaaggtgggcactttattttgcctctcactgtaattctttgaaagtttttgattgttgaatgtacgcaaagagtttcaaatacgtatatgaattgcatacaaggtattgttcaattgatgttctgagcattagaattttttttatatttttaaaatacagcatattacactacaacctaaatttacgaagtcttttttaacgctacctcaatttaagtcactttttttacgaagtaaactcaatttaagtcactttttttacgcagtgcgtaaattgagttttgacaattctgtgggaaatcaatgatctccagtttgggaaaaccgttgtaaactcatacaatatgggtatttttggaacgggcacgacgaggggatgacgaaaatcgatgtcggacgccattttggaatccaagatggcgacctctggtttgggaaaatcgttggaaacccatacaatatgggtattttcggaacgggcacgacgaggagatgacgaaaatcgatgtccgacgccatttcggaatccaatatggtgacctccggtttcagaaaatcgtctgaaattcatgcaatgtgggtattttcggaacgggctcgacgagtggatgacgaaaatcgatgtccgaccccatttcggaatccaacatggcaacccccgatatgaaaaaagtcgttgggaactcatgcattataggtattttcggaatggccacgacgaggagatgacgaaaatcgatgtctgacgcaattttggaatccaagatggcgacctacgattggagaatattgttgacgaaaatcgatgtttgacgccatttttaaattaaattcacctaaacctcaatcaacgaagtttttacgcaaattcaatagacgtcacttgtttaacgaagtacagttaactctcccttactcgatattccgtatctcgatatcgagttagagaaccatagtaaaatttggttttcatggctaactcgatggtcccttggattgaagatgcactggttttgtgttctgtaagtcgatacctccctaactcgatggtcccttcaatatcgagtaagggagagatgactgtaaattcatgaacatcagtacagatcagtacattgatccatttgcttatattaaggcgaagtaggccgtcattgaaatttgtcgtgggcatcgatgattgtggccaaaccgtcccacgattgcgaattaaataaaatcactaggttttgcactgacattgctgaaaatgtatcagcatattttctatatgtaacctcaagtagtgatacttttatgaatcaatattacttgagatgactgaattttatcactttgaaattgcaatctggaaaatcaacaaggctaccaaaccgaatgacgggctacttagccttaagagtttatattttatgctataaataagtatcatcaatgtacaattacttaaatttgtagatactcaggtctatatatcgtggagtcctcggaagtacaaaaacatcgacacaactcaataaaacacttcgtttgcaaatatggacagtaagaagcctttgcaatattgaagaactatctattgatgattgaaaatgaccaacttttgtaaactagatctcagttatttatcgtccgatttgaatgaaattttcccagaacatcagatataacttgaattttaacatatatttttgagtgatttttccaatcacgggtttataaattataacggtttatctaaagtgtaattttcgacgaaaaattcaaatctatttatctcaaatctgatagccctacacaaaaactgtcttcagcaaacttgttcacctcgttaaaatctacaactttgctgaagataccatgaagctattccttcaatatgtttagttatgtcatttataaaaaatcgtcaaaaaattgactttagtcaaaccgttactgcttttgaacttgtaattgaaaaaaatactcaaaaatatatgttaaaattcaagttatgtctgatgttctgccaaaatttcattcaaatcggtctataaataactgagatatagcttaccaaagttggtcattttgtatggaaaatcaaaaaagttgcaaatgttttgtccaatactgtatgaccatcacgtttgtagattcaaaggcctctattcaatgaagtctttggaggacctaggatatcggtacaaattataacaatactcattttactgctatatatagataagggcctgtgccatatcaaaaaagcatctattgataattggttaagcttgtagatcctaagacctatattcgatatagatcttggaggacctaagacatccacacaaattattacaatacacggtttactcacatgaatggttaagggcctgtggaatatttgaaaactaacctctaatctcttattacggacgtagatcccaaggcctatgttcaatggagtccttggatgacctaggacatccgcacaaattattacaatacaccgtttactctcatgaatggttaggggcctggggagtaattgaaaagtaatcgcttatctctaattacggtcgtagatccaaggcctatattcaatggagtccttggaggacctaggacatcggcacaaataataaaaatactcattttactactatgaatagataagggcctgtgccatatcaaaaaaacacagaaaaaaatatttaattttcaatttgatgtaaactgaactctactgtaaaaataaatcaaattcgtgtattgctacagcatcatgtaaatgtaaatgaatatacattcagttttaaactataaatggttgaatattacatgatcgtgtaaatttaaagtgaattcgattgaaaaataatggattagtcgttgaaatttaggttcattttgatgctccaaatatgtgcatgaaaataaacttaaatttacaacatatttttagctgtgaacatcaaaggatcgctaaatatgccagtaaattgcaggtatatattccaggaagtttttggctgaactagaacacatgttgtactcacttaattaccaaaacttggatctgaaaatacaaacgcttcttaaacatataacaatcttctaaggtccagtattgtgagacattcttatacatagaaatgataaattggcaaaacctcgttttacgaactgagctccctcgttttacgcactgattcaatttacgcaccaactcaatttgcgcacccccgatctggttcgtaaattgaggttacagtgtactaggatgcttaggaagctcagattttttcccttttactgtagagcctatttaaccactacatccattatttaggaatattgtgttaggaagctcagatagacaacatagaacattcaatctacgagtccaattaaacacctcttgaaaaactatcaatgcagtacatgatcagtaaggttcagaagaataaacatcgtaggattttgaacacgttagaagctctcgatcatccaacaaattttggaagcatttgttgccaacccccctaaacaaatgttgaaaaaacacgtttttaactgttacttttttgtttttgtttttttttaatatttttaaaccaaattttgacacaagaagcggatatccttctagtttgagggcttggacagaattcaaagattgaccacctggttccgaaattattccggaatcaaaatgggtatttcgaaatggccactttaataaaagtgaatttgcaatgtgaaatcaattgattttttttacaattattagctctataacgatggggtcggatgtctagaaggccatcatggtcactgcatgccgcagatcaccatttccggatgttccggggccatttttggaagcgagtaaatactataatgcgacacatcaaatttcatgattcttcaatcgattgcattctatgactgaactttacagttcagaacccatttggccactttggattcggtatccggtaccggggtaaattattaaaaatcagcaaacattatcaagcgacacatcaaacctcgtggtgttttttgaaagttattactttctatgggacagtttcaacgcctgggacctatttggtctctttggaaccgattcccgggtttccgagagaccggtgcggggtcaatcttcaaaggtgactaaatactatcatgcgacacatcaaacttcatgatttttcaaattattacataccgtgactgaactaaatagtgtagaactcgtttggtcattttggaaccgttatcaacaacgcagtaaatgtggtgaatctctcccagcgatgacagcagtgcaggagaaccaagcacaatagaggaaacagtagaagtagtaacgatagaagccaaacctcagaagccaggtcgaagtgggttgaacatagatccacaaatgccaaagcagtatcggtaaagtgcagaagagctccacaattatgtgggtaataagcgcaatgttctaaaggagatttggcatacgatcgtaaagattcataagataatttcattggctgagaaaaagatacttacagccgaaacagcggaatacgcattgggttcgggtaaagctgtccttgctgtacaatcggaaaattggacatacgaacattaatgggaatgaaaaacatactagttttcatgactccaaagcgagtcaagaacttaccaagctatggtaaaaaagcgagtccaagaatcagacgctagtcagaatgccgcttgaagacagttgcgagataccaaatgtatatacgacactccacgggcatggatgagtagctaaggcaaacgaagctacgacgtacgcagcgcttctcgagataataaaagagggtccggaagatttgggtgagaaccatgcgaacctacccaacaaggagaaatgttccttggtttgaaggattatcttatgattgataaatctgccaaaagcattgtcagatacgtggaacgaagttcaagaaatggttgatcgaagaggagggctaggagtttttgaggtagaataaagcatcgcgggctgcactactgcggcatggtacgtggcaaaacgtggaacgatatagactgaagcgtcaacagcaaacctacctattatgggacaaaagcgccccttggaagaagcgaaatatcaagagatagagttgccgtaccgctcttaagaaacgcggaagttctatcagaagctcaacgcatcccgcaaaggattcgtgccgtgagctgaaatgtttagccctgcacagatgggagcatattgacgaacggacgcgaggtgattgaaaggtggaagcagcactgcgatggacacctgaatagcgtagagaacatagacacagaaggtcaggacagcgaagatgatggctacgtcagcacagcggacagttgaagccaatcagcttctacgaggggggaagttaaggatgccattcaacagctcaaaaaaacaaggccgttggcaaggatggtattggagccaaactccagtattggcctcggcagatacacagaatctgggagacggaacagctaccggaggagtggaagcaaggtattatatgccatatctacaagaagggcggcaaactggaatgtggaaattatcgtacaactatactgccgtgaatcgcaagtcagtcccatctgtaaaaagtaggcattgagaaaatgggctgtgaagttttcaagctcgttttccatacgaatattcaaaaatttccagaggattggaacatgttccaaaccttatgaaactttcacaacttggttttcactacgatatctttccgagaaaaatataaagatcatcaaaacaagttatatttttttgtgttccatggtgaaaagtctgtagtgggactgatatgcgattacttttcattatgggacaatttgacttgctgttttttttcctaatttttccgaaaaaatcatattatttcattagtgcagctgaaagagcattggtggagatgttgaaaactgaactcaactcaattttgattaatttgcagatgggactgacttgcgattcacggcagtataattacacataaatacgaaacgaaatcacatgaattctcagatccatactactgagtcatcagaaatatgataaagaagagaagatagaagaaacttccactcaataattgtctaaaaagcggaaaacatcgcgctctccccagtgcatctttgacgagccgtgatagcgtaaaatcgaatcaactttcgtcattctttccgtgtttatgatgtctcacttcggcgtatcatagcctactcaaacgccgtctccatccaccgcgttgacaatgacgagtgcttccaatgccaacaataacaacaacaaaaaagaatttccccggcaaatacctctctgtactccctcgatccatttatctggccgcagcaagccgcgttggaagttgtaaaaaaacgacaggtaaagaaaggcaatgtggcgtaagaggaaaaaaaaagttactttttataatatctctgtttgctttgttgggtctggctcggaaggtccccccaaggcataggcctactgctgctgctgctgctgccaaaacccgcacttgatggagaaaattcacaaccgcgtgtgattttcggctttcttgcgtagcatcccagcacgcgggggtgggaagcagcaatataataaaatcgcagccatcgtcgtgtagtactcacgaatgcatgaactttgacgacatccacgctccacgcggttgagaaggtaaaaaaaagttgtaccccctgaggggggcgacaaaaaaattactcctcccaccgaaatgatcaaaacggaattcgtatgcaacgaaagaaaggaagattgagagagagagagagggccacccccttcgcgagtagtcgttcagatgcacgcctaaaaatgttatactaaattgggctcttctggaccaacaaataatttgtgtaagttttacacgtatcttaaaatcgcacgagtatatttttgttctttaaatttcatgacatgtaatgctgcttaatattagaaatctcctctgtacgccataaaatgtaaaatagactaagaaatcagcacaaaagcaattttttaggatttggtgaaattgaacaaattttatgttggtccagtagatcccgattttgtgtaagtcattttaaatttttattctttttataagcgtgtacaaaagagtgtttctcgttggcacgattggtagtcacttgaatggtgcgtctcactgctggcattaccccgcaaaggaaaaaagagtggaaggtacagagaaatgaataaattggattacgtttatgaaaaaacatttaatacaaatataggaacaagccgaatgaaaaggcgcttctcctttgtcgatttgacagggcagggtaaagtactttccttttttttttcgcaaatttaacgtagggggatgagtaaagtctggggcatcgttttacatattttgcttttcctcaaacgacaaacggggcagcactcgggcacaatttcttttcttcacttttaatatatatttaaattcgagcgcaaaatgctcatttgtatcgacagtgctctcgagtcaaatgtagcgaaaaagttgccggcgtgtttaagtggcccggtgacgggttttgcttgaatgagatcaagttttggcagggacgtgcttagagttgaattcaaggaacaatatggtgaaaacttcaaatgatttcaaacccttttttaacattacattaatttctcatatcaagccgttctgtgttaggcaacactatcatcctaatatggttagactgaattaaattgttatttacattttttaatatcatattagaattcatatgccatagctgttcggaatctttatggtgattcaccttcttgtatgggaaagaaagcgcttttcaaactagaccttagattaaatataaaaaacctttatattgatttaatttgatgtgtagacaaatacaactagaagaagcttcttcggaccaatctaaatgaattccactccaatgctttcattgtcaatagttcatgtgtccgttaacagctgtattgttctcattaactcttcttaccgtccttatcttccggactcacttaatgccatttaggtgttcgtcgtagtgcgatttccaccttttaataatctcttgtttattggacaagaccttctgattgtaatagatgaaaacctgtgcgtagattttgatgatacgtataacaagactattcacaaaatacatcgcgagaattaatattgattagaataacaataggcagtgttgaacatcattgaaaatgtaaatgcttgaggaacaaaattaatattttgatatcctcataacatgtgtagcttaaaacaatgtcagttaccattgaatccctcagttttcaaggatgcatgaaacaccaaaacgttcatctaacaatactcacgatatccagtttaaaaatcgattcaaatgcactcaactcaagacacacatattacatcttcttccaaaccagctacggaagttcacttccaaactgtgtaattacatttctctgacctcatttacattcaaaaacaatgaagcaagcaacgcagcacacagtcaacgacccttcgcctttggcaccataatttctccataattttattagttccggttggcggtcggtcgaaccgtttgcccctcatgccaatttcaccgatgatatcaaaaagacatttccatcgcactgactgtgttacccaaaaagctgctccgcgtcgtccccggtcctaacaacattgtaacaacgacccattttcccccgcaacttcataccagcaccagcaatttttctttcgcttttccaatcttcgcaccactcgatgcggtatgcaaatttcctgttgtcgcatgcatttgtagacttttcagcaaatcgcgttatcagcgctattgaaaaccgctgaagcttgctattactttctgactttgcactctctatatctttatgttgcgtttgttggtaagtggtgtgagaatgctcccggccaccctcggagacagcatttttttattatctgctgctgcacaaggcaacaacaactcagtgacatttggctttagaatcaaagtggcgggaaaacaagccacttttcccgattctttcaggatctcagtagaagaggataccatcctacgtagaaacggagctcaggaaggggacaaaacaaatgatgacaataatgatgtcaatcgtaacataacgaagttagatccattttcataatcattttgcaattttacatcaatccattttatttctgttttctctctataccggttggattattttccagcgactggtcagaggcgtcagcagatgttgttaggtaataagctgaaaaaggtgacaagttttgcttttgcttgacagaatcgattcaatcggacaactttgattctacaatgaatacaatgcaatacaatgaacaacactgttgtgacgccacttgaacccaggagcataaccgcagcatgacagcttgggcgaagcggtagtggaagggcgcagatagacctattcacaagacgtttcaaatcagctgatcaggaagctttttggcagttcttctaaggaaatgacagcctcgtgtttgcaccggtactccaccgatgtaaataaatacatagacggacctgtcacatgaaaaggcctatagagaggcaggagcaaaacaaaaagtatatgaggttgaggtagaaattaattctgaacaaacatttgaaaagggtccaagaggtcttgagccttttttcagaaacgttgctattgagcgtgatcgagttgaattgggctcaacagcgtgcaaagtcaatgtttaccaatgtagatgtgccctattgaaatgttagtccagaattagtcgatgattgatacagaaatactcgctggcgcgataaattgtagtctttgagttgaagttatttcgaagagccgtgatctctatatcaagtgaattaaactgagccacacgtataaaaatctgattcctggagtcataatcatgattcctcatttgcgtaacatccagagtaacaacactaaaagggatgcattgcatcatttcattcgtttaaatttccttcatttcaacatgataaagtgatattgtggtatgatacgggactatcaatcagaaggttccaggttcgaaactcgtttaagctatttttatatttttatgttgtcgatcataaatggatgcccggttcatgattctgggcatgtgattcatgattccgaacaatccgcaacaaaagcataacgcgtgtgttgcgttacggtaatttgactcatgatgtcatgagtccaaatcatggtgtgttttcataagctgaaaacactctgaaatcatgatatcatgagccatccgcgacgcagttgataatttagggtaacggcacccaacatcagcctgcattgtaaacgggaaaaactgaagaggaagtagtgagagtgtaactgtgatggatgttcggaataattccatatccgttgtgtggttgtcgaagaagaaaagatgcccaaaaggtgttactgccaaagcatagcctgccaggagtaccagaagcggaagaagcagactcgtagtcgtaagcaaacggactagtctaacaaatccagcatccactcccgtttgggggcgtcttgcgtgaatgcgaaagtctcagagtactagaaaaacgccaaaagcgacaggtgggaaagctggcagctgtggaagaagaaaaatgagatgcagcgagggttcgagaagaagataatggcagggctggtagcaagtcactttttagtgacttggtcacttttttcgacctggtcacttaaaagtcactatttccaataaaaagtcactaaagtcactttttttcagaaaaatggtcactaaagtcactattttcgtgatttgctgaaaattaaatttaaggctggttgagcttttcaaacttcatcaaaaagaaatagatatttgtaatatatagagacacatattgtgtgattgggaaacgaaagtgtcaagaaaaatagggaatcctggctaactttctggaagaattcaggtgaatattttgttaacttttcgcataaaaaatggcaaaatttgtctgagaaaatttatgtagggtcgatgtaccaatagccgcatagccaagaacaaatattcgtataaaatcgaaaaatgaagccagtggcattatttttgtatcatctgaaagctttttaccttggctttgtggaacaaatctaaaatatgtttttgtatttattatcgcttgtgcactattactaatttctgttcctatagtagcactagcctcacagagtaggcaaaacacaaatcaaaaccgtatttttacagaacttttatatttttccttcaaagtgtggatcgaaagctaccgattgctgtaaaaaagttcttaatgtatcaactattttatttaataaaaaatattttctcttagtagtgctactataggaacaataggttcactataggtgcaagggagcttaaactttaagcaaaactatttatttcaatcatttttttgaacaaaatcgagctgtgtaccattgatacttagataaatagctaccgtccttcatgttaaaaaatattttgcaacgattactagcggaacggccgtaaaaagctactagtgcgactataggggactgtctactaagggaacaccgaccctaggagattctggaaaatttagggcaacttcactggtggagggcaacttcactgatggagcttgaaccgatgttgcaaatgaagttccaattttattttataccaattttagggtctattttttggaacaggctagcagcctggtatatttttggtcggatttgaaacaagaccttagctgttccaaatctggtttagcatatgtttgtttaccagttcggatttgtgtccctgtaatagccctgtagtctaggaggtgagggtgcaaaagttgagtgatttaaaaaggaaagcgaacatcaggctatttttctggggaatacaagaatttctacgagaatacatctaaagattcctcaacgaagttcttcaacagagtcctccaggagctcttctagaaattctaccgaagttgtcccgatgtgtctaacaaaatttccaccaggaatcaatccatggattcccacgagtagtttccccttggattttctacggggacttctttcaagaattcatccgcggatttgctacagaaataccttcgggggtttcctccaggctcttcgggtatttccatcaaaaatttcttcgtagatttcgtccagaaattcttccagggatttccttcagaaaatcccttaaggatttccgccaggaattcttaaaaaataaaaattatgagatccttcgggaattttctccagaagtttctcagaggcattccaatagcaattccaccggagatttcgtccaggaattcggggatttattcaaataatttatccgaggattgtcccaggaatttctctggggattttgtccaggaattcctctggagatttcctccagaagaaagcgactttaaactgtttatagtgatatcagtggcgattccctaacgtcaaatacgtcaatcgcttactgttcgtttacagtgtaagtactagatatccccgttgatttgaccgctttaaatgtgatcattttttttaatttaacccctgattcattcagaatgcaatgcaatgcaatgaagtcaaatggaacgttgtgaaatgaaacactgaattaaaacgaaacagccagaaggctaacagaaacacggttttaagtatttaaattcaaatggtttgcatgaggtattgtccaaattagcggggttacatggtatgcaaaattagtcattttcagggtcgtagaacatataaatcctgtaacttcacgagttttacgatatgattgttttcagaaattcatttattggaacgttcagtttaattgtagatatgagtcttataagtgtttgcttggaagaaaggggtttaattttacagaatttctgcaacacattttacctttgtttctgtttttctgcttgttttccatttttgatgggcaaggattttttttcagaatgttctgaaatttatcctctttttatgaataagttaaatcttaaatgtaccatctttttgagcaatcaagacttatccaggacagatagatgttaagaaacatttccaacaattgggtcctaaaatgtttaatgaattcttgtttttatttaataatacgaaatattcttgcaactactttagccatttttctagctcaaataacggtcataacctgggagggagaaaccaattcaaaatttctgtacgtcatagtgagccgagattccgctgtcacgaactgtcactgtgagcccagatctcaaacattggactaacatgaaaaaagcgcgtaactgattaaaacacatttttgtatttcttcaaaagtgataaaaatcgaatgaaaatcatttcatgcacataacgcaagtaatgtctcgtgagcaccatttaatctgattgaacataaagcattgaaaaacgcatcgttctactttttccaatgaaaatgaatatttagtgcatagaaaactgtggcccttttttcatgtttgtcaggaaagatcgaaggtgcacaacaaaaggaaactaccgattttctcgaagcctgccttgattgttgttggcaagctggaattatcttgcagttcaagataacgttgtcttatatttcgtgtgtagtatcggtgcctccctcccaggtcataacatttttaaactttaattttaaaaatggttccaaatatgaacctcgacacttgtgatcatgtttgacattcactgtttcgacaaaaatgccgcagggcttatagttttaacactgggtttgttcctatctgacatttcggaagggacacggaaaacaaaatatacccaatatttgagtttaaaccaaggggtgagacaaaatctcaaaaatcataaaaaaaatgttttttggacttaaacaaatgaaaatcatttaaaaattgagtaccgtcggacggggctacttttgattccaggggctactttggacactcaccttttgtatttattagcagcgtaaatattaatctgagcaattttgtgtcttcagcacttttattaaccaatatatgctctaccactaggcatgattttttcttggaacaacatcaacaataacaggatgaacaagaaaacatttcaaaaagccagaataaatattcacaaggtataaaacattggctatacaaacattgtttgaattttacccatgtcttggaaacttattgggagcatcacaaaactatcgaatcgtcatgtttcatgaaaatcttgtgatttgttttgcttaaaattgttgttttattgaaataattgatcaaaggtcttatttttgcgacttttattttattataatgttttggtttgtgtattttacaattaaaaaataaaataaaataaatgtttgtaaaagtgaatagacataaaacatatatatttcaatacgtaacaatgccaaattcacaatataatctctaaaaaactatttttcgtcatattttacatgaattcgtagtacagaacagttgcattcttcaaatgcctaaattaaactatttttaagccagctctaaactgctcagaagctaaaagcatattacaaaagcaaacttacttctttacgatcttgctaaactttacttcatagattgagtttttaatgaaaattacttactggtattaaattagttaccggtattaatgtgatccttcaacatatcgttcatataacagcaagaatagaaaaaagagtttttgtacataactaatttatcatcgcagaatgtagtagttacgtcgttcgtttatgtcaacttgaaaatcgagcattcgtaactgatagttccatttaagaggaagttgaaaaattatgtttcatactgcaaactgagaatagtgaatggcatgtttcgttgaaatttgttatatatgtgtaattgattctagctttgcaattttctacattaactttatcaatgaaaaacgttccataacatcacagtggacgacaatctattgaatcagtttgaaagttataaggaaaaatcttttcgttagcaaattgtgaaaatgtccaaagtagccccttttttgtcttgaaggacacacttttttcgctattcaagcatttttgttatttcttgatggatttgcctcatattttgcacatttgttacgtacatatacaacttaaataaaggcaaaaaatatcaacatctatccataactctaagagttacaaatcctcaaagttaaagaatgtggaaataatgtcaaaagaagccccgtttgacggtaaacatgtgtttttgccctaaacttaagcgtgtgatactaaaattgggacagggctttaggacccttttactgctgttctttacattctgaatattttcaatatgtgcattcgtaaatatcaatatagaacgtattttcgtttctggtttattttatggctaatacttctggttttgaagtcacttttaggtcactttttggtcactatttggtcactattttgatcattttggtcactaaagtcactattattttggcctctgattgctaccagctctgcaatggagatggagttgcagatgcgtgcagagtaagaagcaaaagaattggtttggcaagcggagatgcttcagaagaagacggagcaggtcgagcatatgaaggcgaaccaggaatcgttcggagaggggttgacatccatggacaaggagttagttggattgtcgaactttaaggagccaaagccagcgtcgaaaatagatacgggcgttttgcaagtgcagccttctagcaaaatcaacccaaatgcgttgaagctgacgaagaaagaattcaagaagttcatgagttcagagttccgaatcaacaacaacgcttcgcgagttatcaagaagaaggtcgatagtgtgagctaaaacgagctggcgcaacagcagaccggatcgacaaaggcacagtaggctgtacgaaagggacttacctacaagcttcccaaatttttgggtaatccagcacagtggcctttgttctaaaaatagaaatattagatttagaacgctagaggcgctgtgtgtcccatactgtggctgtgatggtgatgaatcaaccacagtagccttgatttttcttggtgcgatccaacggtacgcaaagtgtcaaattgattgttttgtttttaacttatgtgttggcgcggtaagagaggtaaaatggtctgtccccggaacaactacggatggaaaactcacatgataagaaatcttttgagtcacagttcgacctactccattggctgcaatttgaatcacatggaagctttcgtgtgttgcacgaacgcaagcgatacgcaccataccttgtgagggataaatctacaagcgccctagaatagtgaagaagcattctcagcgttcttatttcagtcgcatgttcaactgatcatccatttaacacaataatcacctgtgcaacagcacacctaatcgagactatcttctgtagaaagaatataattttcaggacacacgaaaaactatttgtttcaacaagccacgaaccgcgcgcgaagtaaccggacggggtaaatgttttggttctgaaagcaggttgctatggtgaaattgaaaaaaagtgacactttgagtaccacatccaaaaaccacatactagatgttggtcacagcattagcagcgacaatagcggtctaatctttatgtctattgttctaaatgaaccatgaaaaccttatgtgactgcaagaagctgttaagagatgcactcgagctggtatctgtacagcttcttcttcttgaaaccatcccaagagtcatcgaaaaattgcatcgccattacggccgtcccaagcagctgttgaaaaatctactgaacaaggtcaaccggctggattctccgcaaccggataatttaaagaacttcattccattcggaaacgcggtggagcaactctgtggccatttggaggccgctgatctacaacaacatctcgtcagcccgctgtcaattaggttgccaagctgtcggatcgttagaagcgtgacggatttcctcatggaaatagtggaagatacctgcgaagccaacgtcgacctagagttcgcaagaagcaagggcaatatactttattgctacagtgcaatcggaaattcactcgtaaaacacgaatgttgttctttacgttagaaaagattactataattttaacagactaacaagaaattgttgccgtttgtgagtaaactgtggaaatacgaatcaattagtcaaaaatgtgagccaactaatccgtaattatttgactgctgagttgcgcgattgacaactcacgcatgaaaattctcaagtgtgagttttgagttatgagtttttcacaacagtgggtgcacgtgctagcgtcggcgacaaaatattactgcacattgttcacgctgtcggcaagttgatgctaccgcatcagaagtaggactttgaggagatcgctgcgcactgccccacatgcgagtaattatctgggctatcatcagcaggttaccgacggaaaattaagcagctgctcaaaagccagtgcgcgctaaaagaattcgtgataatagtatcagaagaattggaggagaaacgcgtccagcaaatactggagtgcacaacgaagcgtgtatgggattattcggagaccggtttgctgcgtagtgtgaaagtgtaaaaaccggtggcgctggacatcagtcgttctgagcaaacgtcgatggaacgtgaagagtttgaagctataccagtacgaaagcaaacgaccggcgaaaaagttcgtcaaaacctgttcccaggtgttagggacgtttttctcgggagcaatggccgttacctctggtttgaatgaaaaacctctcgacagcagtgtttagtgtacacagcagaggtaacggccccccaacaccaggcttgataatactcctcaacatcatcagagttcggttacatactctagagcagcgtgctgcctttgcctttttgcgagggagcggtaatttttcaccggcagagaggcaactaaaaatgagagcggaagatgcaacacaaagcacaacagagtaaaattcaaccgaaaaggagtgccatcacaactctccgaggcctgtcttgttcggacgggaccctcaagagttcttttgatgggtgagtaaaggtgagcaacgcaacaaaagagagaaagagtaccagatgatgagaatctctctcctctttctctttttcaattgtaacagtggaatactaaagcttttgggaagttttttcactatagatcgaaaggctgactagcatttcatacaaaaacacgcaacagaagaggttaatgtaactaatgattaaagagaaagtaaacaaagaaagcctctcaatgtaagatgagtccttttgaaaagctgcgcgagaaatcctcgcattttttgcactcttactcgaatcgctgtgttgaaaattttgagttcagaggagtttatatcaagcctgttcagtggtggcaaactctcttcctttatggcaaccatagtgccaacgtatatgttgtccctctgtcgcgtctatttcgtttggttgtggaggttggacatatactgctccggccatgctccggaagtcctcatccatacggaattgcagtaccgaccctggcacttggccgaccaacgtcgactcggagtaggctgagtccaccgccggggtctaactgagtaatggtcatcggggtgaaaaaccgaatttagtactatatcatttaattccactaaggtttgcatcctttgacagatacgcgtattttgacctcaaatgtaagaacgtcttcagtgtcgtgtactagactcgactacgactcgaagtcaagtctagtacacgacactgaagttggccttacagttgaggtcgcaatacgcgtatctgtcaaaggatacaaactctagtggaattaaatggtataatacttaattcggtttctcatctacttatgtaacttttgttttgcggatatctcaataatgactcattattttaataatgactcattattttaatcaagaaatttgagatttttccaccaggcggcgctaatgagcatgaccattcagaaatatgacctcttcagcaaaggtgatcaatagttcacgggctatcattgttctagtcaagagattcaagattgtttcaccaggtggcgctagtgagcatgtctttttttcgttcgcggatccacaccacgtcttagaaaaaatgtttattcgagccaagaggtacgagattttcgccgtcatgtggcgcaaataagcaaaaatttttattttgcaaatatctaaggttccagagtacttagaaaaatgacacttctggcaaatttgttatcattgttcgagtgatgcaattcatagtttgcccccagatggcactagtgagtatgattttttggtaataattttgaacttcttggctgaaataaaacgaagacgccagctttctaaatagtcaggatctcaagatatcttcaaaataaaagtttcatgctcacttgtataacttagtggcaaaacaatgaatctctctggcagaataattgggctactgaaaagctttgccgaaaacgttacctttttaagtgctcaggatcctaagatatttgcaaaataaaagtttcatgctcactggaaaaatctctaatttcatagctcaaacaatgatagtccttgagtcactgaccaactttgcagaaggcgccatctttctaagtagtcaggatcctgagataacagcaaaacaaaagttccatgctcactagcgccgcctgtgaatcttttgaatctcatgacttttataatgatagcgcttgagctactcaacaacatttccgaaggcgttatatttcctagcgatcaggatctggaaatataggcaaaacaatagtttcatgctcatcagcgccgtctggtggcaaaatctcgaatttcacggctcaaataatgatagcccttcccactgaacaattttgccgaaggcgccatatttctaagtggccaggatcctgagataaccacaaaacaagagtttggtgctcatttgcgccacccggtggctaaatttataatctcatggcttatataataatggtgctggaagtactaaacaactttgacgaaggcgccatatttctaagtggccaggatcgtgagagaaccgcaaaacaaaagttccatgctcactaggcttcctagcggcagaatctcgaatttcatggcttttataattatagcgcttgagctactgagcaactttgccgaagacgccatctttctaagtggtcaggatcctgagatatcagaaaaaaaatcgatgctcactagcgccgcctagtggcagaatccgcaattcaatgaccaccacatgttagcccttaatctattgaacaattttgctaaacatcatgaccctctattttgaatactttttaagatattgatcgtttataaaaacgatcgttaatctgaatttcagtcgttaaaaaagtggtcgtaaaaagaaccgttgtaaaaagaacggtcataaaaagaggttagagtgtataacacacttctgggcgaaattgtcgcttctgcatggaacttgtagctttcgattgaacaatcgattgtaggacggagtaatgacccttcaaaaactccatcaatcccgaatacatcgatacgtccttgctattgtgttgtgtttcccagtggcgtagagttgccatgtcgaagtcaccaatcaattagttgagccctttgtacttttccttcttgagcgcttccacggtaaaaagtgcgtcgagatgctatttgactatcaacttcttacgctcgatgacgatgacctcacatatgtgaacttgtccacatcgcaaattattgtgtgttttggtgtggatcaagttctaggaggctgtcacggtatggcacctattttccacttaacgacggtagttttatttcgggaaattttacctttacatactgagatgtcgcttgcgtatcgggagcttgaagcatggtatttcttgtagcgctggaaagccagcagttctgctttcagcgcctattagttgtcttcgaagtcttgacgaacctgaatgatcggtcactcatttctgcatatttctatcttgcttgaccaggggccatagatttagggatattatcgagttatagcggttgaagcacacaataccagtgcacatgcgattcaagggatcatcgaggtagccatgaaaaccaatttttagtaaggttctctaactcgttatcgagatacgaaatatcgtgtaagggagagttgactgtagtttgctttatgtcaatctttcattataggcctctgcactgttttgattttgtatgggattttgacgtttactagccctgtcgtgaaagagtgaaagagaggcaatgatttttgtgcagagccctataggtactgccgttctacgcgtgcacccccgctaatttgaacggtacctcatgcaaaccatcggggttcatttttaatttgaacatctcgtcaccctagaaacgtgtttctggttacctctttcactgttttgttttgattctgcgttccgttccacagcgttccctttcacgttacttcgttccatgagctaaatgacgtttgaaccatttttaatctgaacgatgtgcaaattagcggggtacagattaaaaagtgttcagattaaatgtggtcaaaccaacggggataccggtatttgtttcgcggtccataatgtttgcatagcacttgcatgagacaagtaggcgtagatgggcagtaaacgaaacatccaggaatagttttgcgcgaaataacgttatgtggaatgtcccattccaacaagtaagcaggcttcattccatgtaataatcaactcaagtaataagagaagattaattattaattcctaagattaggatgaaattattcaaagatctgatatctttaaatcggaacatccaaaaagaaggaaggaagagaaagtggaaacttttggaatcaatctgttgcaatcacatcgtctcaaagactactcccacgagtctgcattcttcttttttctctgctttgtattaatgattttctttctgtttgcataatcgctcaacatatatactgtcagcctctgaaccaagaatatgtaataacattaacccaccccagaccgactttcttgttcatcacaaatcagtcccttggcactgttgcactgcttcaactccgtttgatggaatcgtgtcttggtttgttctttgcaattttaccaacaccaaattgctgccatttgcgtgtccctctttccggcaccgagatatgtttagatgaatatttaaatcagattaccatcaggagagtgttttgctcggttgtccttataggagacacagaaatttgatttttataactgccaaaagccgtcagccaggtgtcattcgcactcgcgtgccatctcgatagcgcccttgagcgatttgagtttgggagaagtttctttttgcaatttcgggccgaattgggatcatcttagaactatctcagacaaatggacgtaacacatgtaacgatttaaaaacgtctagttgtgaagtataaaacattggatatttgaaatgaacgctcgaagcgtgatcgatggaaatttcatcagtgttacgtctatttgtctgtgaatctacccttcccagtacctgtgcttatagtgatttaattttgtatcatcttctcctctcgtccatttgcagaatccctcgcgcaggagctggaactcgagcgcaaggtgcgacaacaggcggccgaaggcgatgtaaaagggcctctccaagatcgttccaattactacaaaaactccgtactgtacagcagtgccacttagttccagcaattacggctaatcttttcatcgctctcaataacaacaacaacaagagcagcaacagcaagcgcagcactcgctcttcttctactgcagttactcctcatcaagcagcagcaagccatgacgtcgttgctgtggtcgtgcagtgtcgaatcgtcgttatccgtggcgtcatggccaacttcgacgctgggaaacctgtatgtgcaattatactactaagagcaaattggatgcaagtgaactcgaggaaacgaacttacaattcgatatcagtgcgagaaaatgagtgagagcatcacgtgcagcgatatcacggtgcttctcggaccgttattatcgggaaaaaatctcgatcaaatcagtgctcagcagtcaatttttataactcaactgcatattttatcgaagttttgaaaaatcatagggcctctttttcaaacacaattgttttcttgagaatttgtaaagttatgggatagaaatggcgtaacttcaaaaaaggcctttcggttgtttttaatttatgcaactttgctattgttatcgactggtgagcacaaatttaagggatttttttctgttaaaataacggtc

SEQ ID NO: 152 - DNA, 17942 bp, Aedes aegypti
  misc_feature (85)..(184): n is a, c, g, or t
tattttgcttgaagatgaaggcagtaattttaaacattagacttgagaggcgggaccagggggatgggagaaagggaggagtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcacaccattgtagctcagcctttactcattcattgccgataagggggcggcttcaccactacacgtgcaataggtaccggttggctgtgcgttcacatcgaagggcagaagacgtcaaaaattggtctagataagttgtctcattttcgcatggcatcgctctttgcctgaatcagcgaacagtgcagtgcaaaagtggcgtttttcgcatttcaattgtaattttccggtgtaaatcgtttgccaatcggaacaaatttacgctaaactttgagtgtaactggtgaaaaatagtttccgcgcgtttgcatccagtgaaacgtgttatttgaggaagaaaaatcgttttgaaaaattcgccgtatcgattttcaccggaggcttcttgattgaacggcatcatggcggcgtccaaagatatcaaatcgttcttctacgaatggtgccagaaagggagctttacgccctcgtttgaagtgcgcccgaccggtaagtagaaaatagtaataggtcgttgattagaaaaaagaacagtaactgttatttcccgttagaaatcttctaccaagtcccttttcagggctggtagcggatatatatttttagaaattgtttccaaagtctttatttttaaacaaaatggtctcagaacatggcgttaggggaaatataccattagcggtgcacagtaaaaaaatacgcatcatgatatcaatagttctgcactttgatttgcactactgtttaatcttggcaataacaaagaaacaatccttaatattatatgcctgctttcaaaagatgaagagatttggtcttgttcggaactcaaaagtgggaaggaagtagtaaaaagactttgatgaactattaatagtttattgtagagttgtaatcagtgctgggaatggtaatagtagtaggcttgaattttcgcgaaaatcacgtggctcaccagtacagtagttccaaaaccgtgaatctcatcaagtagcctatgttgggtgcacgaattttctaaagcatgagtgtcattgaaggctctaaatgcgggaaatacagcgggaaatagaacatttttctacagtaattctgggttgcccttagcaacgggtgttttgctattttcaaggctttttgcctacagcagcgatgggcgtgagattcactggctacgctgactgtgattggctttgcttggctactgtatagtgaatttcaagatttttcccaaccctggttgtaataaaatacgcctgctcttgatgagggcttgattgggaactacaaaacaggtcgatggcgattggcagctcagatctacaaaggtaactttgatcacagttgctgaacgatcgccacaaatggtaagttcgattacacccactctcgatcgtgtaaccctagattcttcgggagagtagcaaagcgatcactatctagtgccttcgtacatatgtcagctaattgatcctttgttcctattggtcatacgtcaagctgtccttcggcaacatgatcacggacgaaataatatcggatgtatatatgtttagctcgtttggattccaaatttttcgccataccgatgcatccgtgattatcttcgaacatcgtaaccggttcgattagcttcactactaaatcctccagaattccagtcaaccatacacgcagcgaactggactatcgaatttcatacattttgccttatgaaaggtggaacgaatattgcaatacgaacgctttatgtatcgttttagcattactcctcatcaaggcgtcgataggcgcgtggtgtacgctcgggcctatcgatcgcaaggttcttggttcgattccaggttgccgcgaaaacgttttttgttaaattaattaactcattacgcgtggtaaagatggacaaattatgggtgaaattatgaaaaaaatccacgtgctcggctgggatttgaacccaggactcttgtatgctagacgagcgctttaccaactaagctaccgagccacttggtgacccaataactgagttggttacaagtttagaattcaaatccctacagaccacgcggacccctttcataaccaatatccatccatctcttgttcctacacacgcggagcgagcgagtgcgatttatttagtgttgaaactgtttgcctatcgtacctacatcgcttccacaacaactgtattgtggaagagtaaagatgtgggaaggctatcaacgtgtcgttctcactcaagtgacgacatgactactacagagaggcagtacgttttttgtttccaaattctggtttcataaggcaaatttatgaatttcaatccgatttcttgtggcgaattttcataagggattcctatgtttatcgatagtccatttgcctgagtgtatagcttcggcagcatcacaacttaaggaaacgtattcggcttcgctcgatgacattgcaacacttgattgtttcttgctagaccacgatatggtgtttccatagactttttttccttacttttatttgttaggcactccgtgcacttggccactactatgccaagtatcatatacagaatctatttatatcctagttcttattgctatttctctcataccgagcaggtagaggagagtgctgccgttggtccaatccatatccattggttttttttttctgttcggaacataaaccactgcgaccaacatttgatctattgtagtatatcccgtgtcctttgtttagtgcatgtcgtgttacattatcactattgagaagtgataaagtattcggttttcttacagttgtaattcctaacttgatcggaggaaaggattctaattgaaaggttccgctatttatacccttagaagaatgtggtgggaacactttccacaggcgcgcccctttatcagtcaaaatcggaacccttgagaaagccaagaaattacaccgatattgtccatgcatcagaatcctagtccttacttcttcaaactagagaactaaataaataaaagattagaaaacaaattgttgtattcgaatcatttttttgtcccatgtctcaagatcgttctcggcaacccggaaaaccgagacttgtcactttcaacaaggtgtaaaaatgtaacaaggactaaaaaaatgttcctttgattattataatattctgttctcttcgtttgaagcagtcaggacgagggttcactggtagatctttaccccataacgcaccacgataaggtgatctacccgcgttatgggtcaaatccattggtgtgcggtggttcattttgtcatgtttatgtgtcgtgtgaggcaacagcctacaaagagagtcagtgtgtctcagtcagcatccgatactgacgaaggatggatgtgttcccctatacacggtccttcgtgtggcgtcttctggtggctggagggagttttttgtgtggggggattaggaattgaacccataactttccgcttacgaagcgaaagcgtaacctcggtcaccagcccagtccgcatctgcaaaaccaataactggcttcgcgtgttcgtaccgtttgaattccatctataagttgaattccttttaaataacgtacgacacgtttaagtgccatccagttttgttgatttggttgttgtttaaatctgccaaggtacccaataaggaaacagatattcggcctagtcgacatcatcgtatacatcagacttcctagaagctcccgatatggctcttgggttccctcaccttgggttttgttcagttgtagacctttctccataggactgcgtgatgaattgctttcagccataccgaatttttcaagcattttcgcgatattagctttttgcgataattccattcttccgttttgctgatcgtattggatcttgaccacaagaaaatgcttcactactccacagtcggtcatattgaacacacggggcagttgcagtttcagggcctgaataaagacaataatcatgtctagaccgtttgaatccgagcctcaaaattactgtttaatttttcgttccaacatcttggcggctgcttaatgccataaagggacttcttcagttagcacacttccccttgcttcgccttcactccgtctggaatcgccatgtaaatctgctcgcgtaattcgccatgcagaaaggctgaacgccaattgctaatactgtccgtatcgtcgtgagctttgccactgagcatacgtctcttgataatccaatccaggtttctgcaggtaacccttgattacaagtcttgccttgtgtctgatgacaacgtcgttttcatcatgtttagtgcagaaaacccaattggattgcaacggtctcacaccatccggacattgaacgatcttccaaacttgaatgtcattcaaggatttcagctcgccgttcacagcagcataccagagcgccctatcatcacggtctgtgatgtcagcataggtcgtcggtgaatctacatggttgagaattttaacagcagaggtcgctttaaaaccggtgaaaaaatccaggaacttacctgggagtttgcgctcccgttcgctgcgcctcgtggttgactctcagtcttcacgtcttgaatgcgaagggggtgtctcaggttgtgtatcgtgtcggtcttcaacttgagcttcgtcctcgtctgtactcagttcatcggagaaatttccggaaacttgatcagcatcatcgtcattatctgtgtcacttgcatcgttcgcagcataatcaatagactggcccagctcagtatgggagaaaaataaagttgtatgattccacggggcaccccccaggattatttcttggggttagacgaagcctttctgaaaaattcagctcatttggtcgttccatgggctggcgcatttgaattgaagttaatatgggattttcagctcaaacatatgagcaacagcacatcatctactgtttggttcaggaaaattgatgatcgcgttcaattggacccagaatgtcaaaaacactacttgatgtaatagcgaagaatattgtataagattgtaccatgatcaaaatgaataaagttgatgtttaaactatctgaagtatatcatgcaacactgcttgtatttcttcaacatagcttggaggtagccactaagcgcatcatagccacctatgacgctgggcacatgtcgcatacatataagtgactgtacgggagtgttgatctaagcctaactttcaacaactgaaagagcaatgaaaatgagattaaatccagatacaaccttctgcaattatgttcattagggtatcaactagtgtcattctgggcttatttgaacgcgaacaattagtatacggaacgaaactgtgacataggatcaattttcaatatatttgtaacaaatatcccatacaaacttcaaatcgaatgcgccagctggtgaaccaaccaattgagttgaaattttgagagagcgtttttcttaccctaaggctcatatctagggggtgccccgttaagttttacaacttttttgtttaagggccagtctaataatcaacttgattctccccctcttgctcgtaacgtattggaatcaccagcggactatcatcaaccggctccgaatttgttgcaaacggcatacaggactcataaagcgtacatttctcgcaatgaaaactttccttgctgacttatcccataaacggtaaacgttcggagcatatccgatcataactccttcacggctttatccatccagcttcttcctcagttgggtaggtatccatgcaaatgctttacatcctaatatttgtagcttccccaaatccggtttagttgtggtccaacttcagcaggagtgatcttttcttgaattgccatggtcgggcatctattcagcaggtacgttgcagtaacaggtgatgcatcacctgttcatcgatttctaagcggcttatgatagcatcgaccgcgaagagctatgtaaaatcatggacgagtacagctttcccgggaagctcacaagacttataagagcaacgatggacagcgtgcagaatagcgtgaaaatttcgggcgaacattccagttcgttcgaatcccgccggggacttcgacagggtgatggactttcgtgcctgatattcaacatcgcgctagaaggtgtcatgcggagagccatgttcaataaccgaggtacgattttcacaagatccagccaatttgtttgcttcgcggatgatatggatattgtcggcagaccatttggaacggtggcagatctgtacacccgcctgaaacgtgaagcgacaaaagtcggcctggtggtgaatgcgtcaaaaacaaagtacatgctgataggcggaaccgagcgcgacagagtccgcctgggaagcagtgttacgatagacggggatacttttgaggtggttgatgattttgtctacaacggatccttgttaacggctgataacaacgttagtcgtgaaatacggacacgcatcattagtggaagtcgcgcctactatgggcttcagaagaagctgcgatcgagaaagattcacccttgcaccaaatgtaccatgtacaaaacgcttataagaccggtggtcctctatggacatgaagcatggaccatgctggaagaggacctgcaagcacttggagtgttagaactaagggtgcttaggacgatctttgacggagtgcaggagaacggtgtgtggcggcggagaatgaaccacgagctcactaggctctacggcgaacccagtatccagaaggttgcgaaagccggaagggtgcgctaagcagggcatgttgcaaaactaccggacaacagtcctgcaaagatggtgttcgcgtcgaatccgattggcacaagaaggcggggagcacagcgagcgaggtggcttgatcaggtgcaacaggtgccaaaatcgaagttggagagacacagccaaggaccgagtaaattggtgtaacatcgttaacgaggttttatcaaattaattgatgtaacaccaactaaataaaacaataacgttgcagtaaacgcagcatcaaaccacatatttttaggcattcttgagtcgagtagcatgcatcttaccttttcaaccaacgtacgattgaatcgctccgtaacatcattttgctgcggtgagtaagcgaccgttggctggatcagatcccctcctgcctgtgaaacttccgttgctcattgaacaatattcagtgccttggtccacggtcaacttgccgatcttgaggctccaatgggctgacgacatcgccgcatattctttaaaacaatcaaataccgtaaaatggggtgaagttgatcactttagaacgattctgttcccacacagttaaaaataatgaagattacacgtcatgtaaactccatttatgcgatgtaaacatggaagaccttgatgaattaataacagtttattgtagaattgtaataaaatacgtctgctcttgatgagggcttgatagggaattacaaaacaggtcgatgactatggggctctgcacagaaatcagtctcactttttcactccttcataaaattagtaaacaacaaggccagtaaacgtcaaaacctcatactaaatcaaaacagcgcagagccccattggcagttcagatcttcaaagttaactttgatcacagttgctgaacgatcgccacgaatggtaacttcgattataaaagatgtctgttcttgatgacaaaattgttatgccaaatgacccacattccagggtatcctgaaccaatcatgtacgctctagacgttataaaccaatataaaatgatgttctaaatgataggcttctgaagtaatacgagaatggttatccctatcgaagttttcaggtcttctagaacctattctgtggcgtctgagcagccaaaatttgaccgtttgaaggtttacttttaaagtacttacctctggaataccatgatcttttttgttgtcatgtttaaatgaacaaggttccatcctcgacatagagtttcgttctacttcgtcgtaagcgctattattcgtcatatcaaacttaaaatgtttcaatacggcggatattccaacttacctgcatcctggttaactaatgcagttgggccatggatgccaccgtgtcggtcagtggatattggacattgattcacactatcaattgaatacaatgttaatacatttgattcgcaatatcgattgaatacaataaatactcgagttcttcttgtttgttatactttttttcaaattgaaatactatttaattggaaaagccaatgcaaagcagaattgggtttcatttaactataccgataaaaatcaataaaaatatcatctaggatcttttatgtttcacttggggtttgtagatttacgtagaactacgtgtggtttctaccagatcacagaatgctgctgtatatattttcgattcgcttcttagcctactcaataatcgatcggcttttcagccgtataacgacaggggttggatcattttaccgaacgcgctagattagattcgtacgcggtacgctacaggatccactaaagcacttcgtagaagctacatgaaaattcatgtagcagctacgtaaacttcgatggaactgatgaggtctatttgttcatgcgttcattcagtggtacctatgatccacgtaagtgctacgtgaaaagtgcgatggaaaaaaccacgtatgttttcacgtaagaatgacgtttggattgttttgagtgtatacggttcttttgattgtgttgtttttgctgcactgtgaatcgtgcctcatatagatcgttgcacgcttgacctaacctcgaaactccatataaaaaaaatgtcaacaattccagcagtgaatgtcaactccatataaaaaaatcgaaacaattctagcagtgagtgtcaaagagcaggacagtcaattgagcgtgatgaaagagggacagagaaggagaatttttcgtgacgtcaccatgcactcttctatgtttgggctgaattttgatgacgaacaatgaagtttaaaggaaattagtatattccatcatgctgaaggaatggaggaagaagcccgtagatctatatattctagtaaaacattttattgtagcgttgatatgctgtgttttgaccactcaatatatcaccgtgaaccgtaagttatgagacgaatctggaaacttattgcgacagaaatgaaaacgacacgacggattgagaatacggcaagatgcattttcgttgctttgtttccaaaaagagatcaagatttatcaaaatcttattgtacaatgataaagccgttttgagaaagaattgtttggcatcggtttgtatcagcatcattcactgcaatactgggtaaattgaagttctcactgatcaatgcttgatacgatggatattagcacatcactctacaaaaatttagcaattcggtttgctagtttctgagaatgagccatttgaactttgaagcattcaagtcttgtcccggacttttgggggttcataatcaaaaattcaaatttaaattccaatcgttattgagcccattttcagcccgaccacgtaaattaaccactacatatcaggaatatgggtttcagctcttcctcaaatgtagtgctactgggcccaacagcagttgcaaagtcattgttttcctatgttcaaatgtttgaccagaaaaaaaaaattatcttcatcaattgattcaattcgcaggtcccaagaaccggcagcgtttcctgtgcgaggtgcgagtcccatcggaggcctacgtcggtgccggtaattccaccaacaagaaggacgccgaacgtaatgctgcccgggactttgtcaactacctggtccgtacgggaaaggttgcctcctcggatgtcccgtcggaatccgacaatggcgtcggtggcggcgatgggggtgattctgctcctgcctccggaggaccgccttcgcttatgaacataaatccggccagggtgttccagagcggtttcggcccctcggaccttggtcaggcttaccggccgttcatacgtgacaacacgtacactccctcgaaggaggaactggccgagcaggaagccatcatggagtcggcggaatcgcttgacgttaacgccggaatccacggcaactggaccattgaaaatgccaaggccaagctgaaccagtggctgcagatgaacagaatgaacccggactataaatacaccgccgtcggtccagaccatgcaaggtaaaatttaatgatttcttattataaatctgtaaagtgtatgagttcatttccctttatttcgtggtttttgaaattgagagaaatgtgttagtcagtctgttagatcccttcttctgttcccttttctgtccgtataacaaattttactgttctccgaaagaactcatgaaatttggctaacaccgctataaaactatctcacgagtgcaacgttcgaaagaagaaacatagatcgcatcaaatgtttgccagaaaaaaagccgaggaccccgttatcgtgagaaatattcttgcttgcgtaggatattcctgtaccgatgctggggcaatgagtattcgttgtgatcacgatggcaaacattcgaaatgatctttattgtttttggttctgtttttttacgcacactacaaaggtggtggccaaacagcggattgaattggaatggacgattatccttcggaagttgcactcgtgagatgatggctcgttgatcgagttgtacgaagctgaatagtttctgaggtaagtttttgtggattatctaatttgtcacaagagtaattaaaacgatacaaacgtaactaacgtcaattagtcatttattaaattcaacttccttttaagggagtaagatggggcaaaagttgtaagagaaaaaaaatattaagtaagaaaaaaactataacagttcaaaagaaatgaataggactgtgtggaccctcaatctaatggcaacacacaatataggcatttatttttgcgacagtaatactttatacaaggcagttatactttttaaactgcaaaaactttataaacattattagacatccataatccactagaaaacatggaatgtctatgatgctaacgaaatccccggattacggtaccagcttcagaacattcagtgatccttaactcatttttatcgcttgtaatcaagcgagccttgattggagtcacaatctttcaattacctacaaggcaatgctcaatagtgattaccgagcgtgttttatttaggacaattaggaaaatatgttcaaggtaattattcattcatcaatcgcatttacaggagctttatggccgaaatgacaatctacgtcaagcaactgagccgtaacatcaccggtcgcgagtctggctcgaacaagcaatcggccagcaaatcatgcgccctgtcgctggtgcgtcaactattccatctgggcgtcatcgaggcctacgggggcaacctgaaaacggccaagtaagtgtcaatcattgctcggctcaatctcagtacttttcactatttttttgtgttctcgcaggaacgcggagcagttgaagcccttcccggttcgcattacgcaacagctggagcagcgcattgagcagtgtctgcaagacgttgaaatacaaccggtcaacatcgaacggaagggcgatcccagcgaaccggtcagcctgttgcacccgtctgacgacgtgcactataagccgcaaacggtgaatctgaaccagcaggcgtcggtcattccgtggtctcctccggtgccgaactggaacccgtggactgcttgcaacatcgacgaaggctatctggccacggctacgctggaccagttgagtgaggatttgatgaacgccgcgcgggaacgtgcccaacaggacaaggaattgcaggagcgtatgcgagcacgctcggaacttcccatcgcagtgatgcgaaacagaatcatggaggcgatcaatgaacatccggttgtgttgatccggggtaataccggttgcggcaagacaacacagatcgcgcagttcatcttggaggattacatcaattccggacagggagcgtactgtaacgttgccgtgactcagcctagaaggatcagcgccgtgagtgtggccgagcgaattgccaacgaacggtgcgagaatctgggcgaggcggttggttattcggtgcgatttgagtccgttttgccaagaccgtacggttcgatcatgttctgtacgattggtgttctgttgaggaagttggaagctggattgcgaggtgtttcgcacgtcattgtggacgagattcacgaacgtgacgtcaacagcgatttcattctggtcgtcttgcgcgatatgttgcacacttatccggatcttcgtgtgattctcatgtcagctactatcgataccacgctgttctccgattactttggaaactgtccctgtatcgaagtcgtgggacgtaccttccccgttgatcaatactttttggaagattgtattcagttggtgaactttgtgccaccaatagacaacaggaagcgtaagcgtggcggaaacggtggaaaggatgacgacgaagatggcggcgaagatgccacggttaagatcactggcgaagcggacacttccaatctgaacatggtgattgacgagcacaagtattctgttcagacgaaaaaccccatggctcgtctttcggagtcggaagtttcacatacaccggtttgcaaattcccataaaacttattaaacttagtcaattcgtcagtttcaactttcaacgacaacgaatattagtttccgaatgtttccaatttcaactcgactaagaggagcaccggacagagccgtaaataacaaaagcaggaggagaacagttcttgtgcgaaatttggtgagaaatattgtcttaaaccgaatactgatgatgttccacatcagtttgccgacccgtcagctcgctcaactgtggaaatccaattctctcgatttccaacatgtttagtgatttggaaacagtatgacgtatctggtgttcgaaattttatgttttgattctacatataggtcgctttactacactgacaacagcattgcggtaaaaaataccatgttggtggtttaaattaaatgcgctgcaccacttgatttgtgcagactacgttactcattcatctcaaacggaaagtgtggtcttttttaccatgtcgacgatatttgagccatcagtcaaaattaccatgctgcatggtaatcttgacaacaattcatagtcatttattttaccatgcgatgcgtttaaaaggacagctatcgtacagtaaatttgagtattctttatatttattccaacccatcaaaaaaactactatccaattccatcaatcgtaattatttattgaagaataaattctctgataatgtattgtgttttctagtccattaaaaacaggatttttggatttcaaaaacggcgatcgtagtggagtcttgcagaggactttatgtccgtatttgccttcattgatctctgatggaacatggcggcacatgcagaatctgctcaccatcgctcaaattttctataaaacatgtgcatggttaatatcgcattaattaataaaacgatcaataatggaatactcaccaataaaagtagaatgaagtagtcttaaattatattttggatcacttatttgggtctggaaattgcacgatgcaatctgcaaaatgaaaataaattgctgagcgaattgttgtatattttgtgaatatttcttaccaattctggaaattctggattaatagcagcatgggtagaatagttactataaaaacattgcttaatattacgtccaaaacacaaaacaaaagtcttttatatccgcgctgatgttaatccttcacaagttgacggagaaaaacatccaagttggaggggtcattattactacgttttgttgttaaaattaccatgcacatagtaaaaatgacaacattgttcattaaaaattaccgatcttgtatttatcttcaatgcagtgcaacagtgctcttgacttctcatgatagtaaaatttatcgattgatggcatagtaattttaacaatattgcagtatttgtaaagacaaacacgttaaattttaacataatcctgaatagtaattttaagaactatgcagcggttgtatttactccaacattagtttcagtgtatgagcatatgtacggtgtatgtgctagcatgaaaaatgttgacagttgagtcgctttgcaaacgaagggtgtatgtagccaaattaaaaacactgagtaaagtgcacatagggcataattttaatttatttctaaaaatcaaaaaatggatgtaggaatacttttatagacacaataggtagattatgcgtttgtcaagcccatgcaaagcaaatctcgatttgtttatttttgcagatacgtcggattgaaaagtttggcttgaaatgaaagaataagcctccaaaccaacatcacgggcaggtagataatgatcctttcttccccatagcgttgtgaaataacatgaaaatccgttcaaatgctcagaaacaatgagctacacatatggttaccaatggcttttagggcgagatcagaaggtttgcgagaattggactattcaaatgcagtttcttgaagattttgaacaagcaaaattttaaacattatgaattgaaacaccactccctatcagtttctaacttgatcatgcatttccataggaaagggtcgtgccggtcgtgtccgtcccggaaagtgctttaccctctgctcgcgcgcccgcttcgataagctggacgaacacatgactccggaaatgttccgtaccccgctgcacgagttagccctgagcatcaaactgctccggctgggttcgattggacagttcctttccaaggccatcgaaccaccgccactggatgccgtcatcgaagccgaagtgatgctcaaggagatgaagtgtttggatgagcgggaagaattgactccgtttgggcgcatcctggctcgtcttcccatcgaaccgcgtctgggcaagatgatgatcctcagtactttgttcggagtgtgcgatccggtttccacgatggctgccttttcgggaacgttctcggaaattttccaactggacgttggacagcgccgtttgatgacccaccagaaggcactgagtggaaagaggaattccgactatgttgccatgttgactgcttatcgggtaagttaacgtgcccgtctcgtcgagagagggctatttggcataaagtaatttgatataaaggtataacatttggcataacagacaattggcgcatctgaatgtttatataaaatgtccatatggcaaaatgaccgtttactgtacacatggctccatattatgccaaatgtccgttataccatgttataaacgttcaaaataatgccaaacgtccgttatgctgaatatcctctatgacaaatgacccagacccgtttggcataaccatactgaacacataatgtcgcttgcataatggtcatttggcattactggggctccataatatttatgaacatttttttcaaatcgacagttcttcatattgtactaaatggtcattatgccgaatgaccattttgccacgtggcccttcgtcattcgaatacttatgccaaatagctttttgccaactgaccctttgccaaccgactttatgccattcagagtagccccgtttttgtcgataggtactcactaaatccttattccattcacagatgtggggcgagaagcgtcgccgcggcgaggaagcggaaatccaattctgcgaatggaagggactgcagctgtcgacgctccgcgtcatgtcggaagccaagcgccaactgttggaactgctatcgcaggctgggttccccgaagagaccatggttgagatgggcttcgatcaaaacgatgacgatccccgcctagatatggccctgtcgttgctctgcgttggtctgtacccgaacgtgtgcgtccacaaggagaaacgtaaggtgctgaccacggaatcgaaggccgctctgatccacaagacttcggtcaactgcagcaacctgcaggtgactttcccgtatccgatgttcgtgttcggggagaagattcgtaccagagccgtgtcctgtaagcagatgtccatggtttccccgatccatatcctgctgttcggaagcaagaaggtggaatgggtcgacaacatggttcgcatcgataattggatgaactttgaaatggatccccaccaggctgcgctgattgtcaccctgcgtccagtgctgcaggatcttttgattcgggtgtccgaaaatcccgaagaagccaacgcgctggaagaacgctatcaaaacctaatcgatgtggttaaagatctgtgcgtgttcaatgcaggtgatgagggaattcagcgagaaaccggtttgacacccttggaccaggcgcgatcgaatgcgaataagttcccacgttcggataatggtggtggtaaccgctttggtggtggcggtggtcctcgtttcaacagtaatggcggaagcggtggatttggtggaaaccgcggaggatacggaggaaacagcggaggatttggaggaaacagaggaggaggtttcggaggaaaccgagggggtttcggaggtaatcggggaggctatggcggcggtggctatggcggtggtggccgacgttggtaatctgcaagcaccttggtaggaaacccttccacatgattccaatgttcaaatgacgcagttttagacgcgagcggagtgattttgagagcagtagagcgacgctttgaataattgactaacttatcaacttcttaattttaagtgatcttttctcataatagtggaactagtagtagtggatcctgtagcatttggatagcttaaaagtatccatatttgtaatttgtcttgatgcttgaatttcatggcgacgtgccgaattatggcatttatgataactgagacatgaatataaacataaccaaataacatcaatatgcgatttatgattattccgaaattcctttatataaaagattaccttttgtcgatcggttttaatcgagatgtagctcatctacgcgaggaatgtccgactagctacgaatagacttgcagaattgtgtgcaatcggatgcggtgatagagtttgaacataaaatatatgttctactatacgtcaaaatcgtagaacatgttttaaaaaatcgttaatttcattgagcaaatatctttgctcacctagcatttgtagctgcgttattgttattttagcttactgatagttggaccgattctataacattcccccagaaaaccgttccccagaatttagcattccccacctcaaagtttaaaaaaatcgaattaaaaatatttattggaatctccatacatattgtgggcttcgtggccgtgcggttagcggcattagtcgtttaggcgtattgtgccacggcgtgtgggttcaattcccgctccagtcggtggaaagtttttgtcaaacgaaaaattcatcactgggctactgggtgtttctacgacagctcaggggattggggatttcaccggattggaattaaattgcactgtg

SEQ ID NO: 153 - DNA, 3508 bp, Aedes aegypti
atgacggcgagatagggggctgaacacaaaaggttggtgttttccatagtaatctccatataaacttcaaatggcgtgtgctcagtcaaatttcttccgaatcacttcaaattttggtaggatgctatttaccataattgaaatcgtttaagcataggggagccaaaatttcaaaatttgcatcactctactggccatggtgcaacaaccgcgctacattcgatgaatcctatgcgacaaaaattgtcggcgctatccgtcaaaatcactcaccaaagccattttggtggatttaccatcacagctatagtgttacggtccacacaaaaaaataaaattgtccatacaaaacctgttacgtaggggagggaggggtctaaaatagccaaattttgcgttacgtaatatttgaatgaacacaaagatgttgactacgctaaaaatgatcccgtgccagtgctcagcacaatcattttcaccacagattttttttcccgtgtacttcggcattgaacgcactccgttcccacccctgacagcgcggatgacagcgacgggctggcagcagccctacccaaccggaaaccaactcgaaacgtcaaaccgctgtcagcccgcgacagcttccctctttccggcattaattctctgctagtgagcacacatttctgtgagcgctagtaaatttaacaccgtgtaagtcggggaattgtgatttaatttggctgaaattctgtgcgatgggtggataacgaagtggcgtatatgtggatatataaatttggtggattttgtgaaaatttgatggtttattcgattgtttgacaacgggagaatttggtgtcaacattgcgtttttggtggtgtggaaggagaagctgatcgagaagaatgattgtgaacttttacctataattacgaatttgtagtcgtgttgaaatctaatttgtgttatttatttttcccttggtcattacagcaaaatgggaagacgtcccgcaagatggtgagtattgtgtttttgtgttagattcagaaaaatcgctcgtccttgactttgagacaggaagcctttctaacccgtttctaaatggcgagtcattgaaattgtgattcattggcatcccacagggagaaaggcagatcaaatagacaaacaatagggtgagaaagatatcctataaatcgatggaatcgcttctcaatgttgtttgttacaaattcacaacttaagctcgaggacgacgatctttcgggacccggagagaagagacgttttctaacctcggattctttccccatttcagttatcgctactgtaagaataagccatacccgaagtcgcggttctgccgtggtgtcccagatccgaagatccgtatcttcgatctcggtcgcaagaaggccgccgtggaggatttccccctgtgcgtccacttggtgtcggacgagtacgaacagctgagctcggaagccctggaagccggacgtatttgctgcaacaagtacctggtcaagttctgcggcaaggaccagttccacatccgtatgcgtctgcatcccttccacgtcatccgcatcaacaagatgttgtcgtgtgccggagctgataggtaagttctgggccccctcttaagggaccactttcgtctacgagctcacagtgtatctgaaattgttttgagcgaaatgagtgtcaaattcttgaacatttttttcggtaataacagtttcagaaacaccgtgaacccctttccatgatgatacgctttctcagagcattgggttatgataaaatcatgattaccctttttacacgttgacacattctgaccgttttgttattcgtagcatccggaacatctatttgagtatattaccagcattctaaacaccgttttcccgttttagactccaaacaggaatgcgtggtgccttcggaaagccccagggaaccgttgctcgcgtaaacatcggccagccgatcatgtcggtgcgctccagcgaccgtttcaaggcccaggttatcgaggctctgcgtcgtgccaagttcaagttccccggtcgccagaaggtaagttccgaactgtctctcttagaatctacccagcggtatccagatgagaatgtaggaagaattatacgaacagtgtagcagtttccgacactcaaggcagacctctttttaaagacttgatcaatagtatctattttgatgtagcttagtttgctgtatgtcggaaattggacgctgttgaaatagtatttcctttctaaatttagtctaaaccttgaatctcgccgttttctaggaggagacccagagatttggttcagctgaatttccatctgaaacaatcgctattctcgctcttatatgatgagtaagcttttcagagcacagggctctgatttccccatgattagaaacacccttaatcacgttgactttttgactgattcggagttaatctcaaaattccccaaccaccttaattgaacgtttgtaacacacaattctttcccttccccaaattccagatcttcgtctcgaagaagtggggcttcaccaagtacgaccgcgatgagtacctgaagcaccaggaggaaggccgtctggttaacgacggatgcggtgtccagttcaagaacgaccacggcccgctcgccaagtgggaacagcaccagcgcaaccgtttcggcgtgtaagacgttcgtttccagccgaatccagaaccgcgttttgtgtttaggttgagatggaaggagaaggaggagccccgtgtattgttttgtacgctaaggactgagaatgtgcgaagaaggagggtgaaaatgtccgaaaggaagaaaacaagaccaggaaaataaagggggaaccatattttgctggcaaaaaacgtaagtgttggatagaacattttcttcggatgacaattccttccttaattcaaaattaaagcattagtatctagatagccgtattggtaaacgcgcagctattcagcaagaccgagctgagggtcgtgggatcgaatcccaccggtcgagaatctttccgcaaaggaaattttttcgacttcccatggcataaagtatattcgtgcgtgtcaatcggcaaagaaaactcgttattaactgtggaagtgtttataacaaccaacccgggagcatcatgacagctgcagtacaacgttagtgtaccgaaaaattttggtccgtggtactgtcaaactcaatgaaatcgtggagtgtgctcaaaatagggcgtaaactagaattatgctgatggacataaaaaaaagttttacaatttttgtttggcatttggaatatcattataaacgagtgatcaccaaattacgattctctgaaaggatttgtacggccatcgggaagattttgtatggcccacgagcgagttttggatagtggtgtgatgtggtcagcatgctgtaaagttgcttaccaattaggcgtacaagtcatcgtgactatgattttgatc

SEQ ID NO: 154 - DNA, 2193 bp, Aedes aegypti
attcgaaaaactactgtgtagaggtatttccgataaggtttggtgttcctttcggtagttatgattttttaaagcttgaaaataacccaaaaacacaaaattgatttgaagcaaacctaaatttactccaaattgactgaaattttgaccagaagttcatttcgacatgtaatattaaagtattggttgactggggagtttccagacatttttgaaataatgaataagtctaatgtatacgcgcttcacatcaagagcatgagatcagcttgccatgagcgcacaaaaataaacgtgcgtttgagcacgtgctatggcgagaaacatttttttagatctcatgtagcaatatactagctcaaacgatcacattgcccgaagaaaacccggattgtgcgcgaaacattccgaattgtgtttgtttgatttctccgccaccaatactgaagtattttcgagcactttcaatttttactacccaccgtatcccactgtccacctcgccggaaacggactttgcgtttctccgctcggtgcgttccatctgtcagttatgacagcaaaaactgtcaccagttgtcaaacggcagccgccttcgctctttctctttccggcaatcgtatggaattgttgtaacacatttcgtgcaaggtgattttttgtgaattttccgtgaaaaatcgaaggatatttgtgagagattagtgtaaaattgtgcccgatagtgcgctcgatgtgaatctgtgattttgactggtggatgttggggttttcccggtgaaaactgatgttagaagatattgggtgcctttccccctgtgtgacagtgtcaatattgaagagcgatttgagtgctgggcaaagaagatttacactaacctcttatgtttccttcatataaagtgacttattggtaaatctaaaatgatttttgtgttcttgtgcgttttccccggcagatgtttatgcccaaagcccatcgcgtcgccatctacgagtacctcttcaaagagggagtcctagtggcccagaaggatttctatgccccgaagcacccggagctggaaaacatcccgaacctgcacgtcatcaagacgatgcaatcgctgaagtccaagaacttcgtgaaggagcagttcgcctggcgccactactactggtacctgaccaacgagggtattgagtatctgcggtcctacctgcacctgcccccggagattgttccgtcgacgctgaagcgcgctgcccgttcggaaccacagagggcccgtgccgctgccggaccccggtctgccgatggccccaagggaggcgaagaccgacaggcgtaccgtcgcacccagcaagccggaggcccggacaagaagggcgatgtcggtgccggagccggagatgtcgaattcgtaagtttcttgaagattgtgtttacctatcgaacgatctaacgtttctttcctatttctttttttaattttagcgaggaggatttggccgtggttccaagccgcagtaaggcacggattgattccatctgtgtatatttaataataaaaagtatgatctaagaaaccaatcattcgccaccaatggaattcagtgttgataaatcgatgaaagaaattcagtgcatgatggattaaaagtctcagaaaacacgtaagtattgcctctgtctagcgttcagtatcataatggcataactgcagtgatctacttctgtttatggatgatatctccgtttcacagggctggtagcaagtcacttttttgacacgactataatgttactatttgcaacaagtcacttttttgcaataaaatagacattaatttttgggccctgattataaaaacaacaatttgaaaaagctagttaaactaaaacagcaaggcagattttctgtattcttaatttttggagaacttagtgacgaaaattttgacaaaatttcagaaattatttaaattttattgcaaaggtattgaataaaatttggccgaaacccgggacatatttatggcagagtagttgattgaattgccgtcagaatttacagagtatatgccaggagagaagttttccaccacaagttttccccaggtcagcaactactttggcactcctaccaaaaattgtttttgggattcgttgaaaattctacttagaatttctaaaatttgtatgcgaattt

SEQ ID NO: 155 - DNA, 31617 bp, Aedes aegypti
atccttaggcataaactcaaattttggatgtattttgttttccgtgtcccttacgaaatgtcagataggaacaaccccagtggtcgaactaaaacccctgtggtgtttttgtcgactaagcgaacgtcaaacatgatcaaaagtgtcaaggttcatttatggaccaaatttttaaattaaagtttgaacatgatatagccattatttgagcgggaaaaattgctaaagtagttacagtaacatgctttttcgtgttattaaataaaaacaagatttcattaaaaattttaggacccaattagtgaatgggccctttagatgttacagctcatacaagatttttataatgttcatacaaaaagcgttacgacggggtgggtgggtgtcaaaaatgaccatttttggcgttatgaaatatgtgaacgaaccctaatacctatcagaggacctaatgtttaaaaattatatttatttattaatttcgcaatccaacaaaaactcccagatgcaattttgcctcagtgtcagcgatcaatgattgaaacatttcaatccgtatccgatgattccaccagctggcgcttccgtcagtgattatcagtgacagcgacagcacaaaagaaaactgcgtgagagaaaaatcaataataaaagattttcaccatcagcagaacgaagcagtttgcagcaaaagtgtagttttattttattgtggaaaaaccaggcaaaaagtttgtaatttgctgcggaaaattgtaatcgacgccctgtgcaacgatggccgataatgagcagaaagctctgcagctgattgccgaagcggagaagaaactgaattcttcgaagggatttttcggatcacttttcgggtgagtttccttcttcttccaggggggcgcaagaaaagtgaaaatttgtgtcccctccccagacaggtagagtagggacttaatttccgtgggaaatggattgagatttcgcggaagggcaatatgtaaaatacacaacgcaatcatttgtggtgatctattacaaatgagtcattgttccttaactgcgaagctagatttctccttgggatggcaaaagaaacagaatggggcagatgacgatgtgtttctgtctgtaatcagtctgatggtgctccaggtatatgtaggtatacatatagttcacttgcagcgagtaaatggaatattattggtatcatgaccctggacaaatttgtcgagtcaatttgtccaaaaacaggggttcccaatctctcgatcatcaggtttatagataaggatatgtcttcatgtaatagaatcacaatgaacaaaacacatttgaaatgttcgtgagacagtacccatataaaatcgataatttaaagcacctcttcgtaagctccattggcttttcagtaacgatcaacagtattacagtattggacaatacatttgcaacttatttgattttacttacagaatgatcaactttagaaggttagatctaaaaaatgagttatgtatggaccgatttgaatgaagtttttcagtaaattttatgtcatacaaattgtatgggatccattgaaacaacagggtgtctcatacctgaaaacacctggaaaagagctgtaattcttaaagtatttcggctacactcaggaaaattattttgaaacagtaatacatagtaataaaaaacgacaaattctatgtttttgcgacactaaaattcctcacttatttttttttacggctgtcattcattcatttattttgttaacatctaaaccgataacactaaatcaacaattgcacgccacaatactcggttcgtggccgcatgtctctatcctcggttctgccccacgctcgccaaatcgatacgcacttgatccgcccacctagctcgctgcgctccacgccttcttgtaccaaccggatccgaagcgaacaccatatttgcagggttgctgtccggcattttgcaacatgccctgcccatcgtagccttccagctttagctaccttcacgatactgggttcgccgtagagtttggcgagctcatctttcatcgttcgccgtcacacaccgttttcctgcacaccgccaaagatcgtccagagcacccgacgttttaagactccaagtgctcgcaagtcctcctcgagcatcgtccacgtttcatgcccgtagaggactaccggccttacgagcgttttgtacatggtacaattggtcggtgttaagtcagagtggaccaagtgacttttttcatattttgagaaaactgagtttgaagtttaatactaacaaaaaggccagcccttcctcacctacccttcctggttttctccaaaaaatgagcataatgtatctccttaggaggagctggaaccgccttggaaaagactgacgcggttgagactctagcatttgaattgaaaaatgtgtgctagccaccgacgaagcataggcaaagaccaaagccgtatgtttccgtagggtacatgcgtaacatgacaggtaaggcaaacataattgcacaatagcactcctagtaagcgcatgtgacgagcctcatgagatgtcttttgtacgcatctgtatctcgtgtctcacatggggggaaatcgcagcaagccatgcgtgcgggcggctgcgttttgaattttgtgtcacgtttacctcgtccgtgttctttttttagtaattccgctggtgaaaataagattccgcggtgctacgccacgtgcaaattttctgtttttcaaagtgatagatgagttttttcatcggagattatatatgaagatgtcttgtgaagtcttattttttttaaattttattcgatttgcttgcgttttgctcgagagtgctttgtaatggcaccatcaattgaatttgtttcgtgtgacttgtttttttaatctcccgtgcgtgttgattcaaaaattaaatgtggttcgtggatgctcgattcgggatgggttaagaactgcagtgcgtgcattttgatgggcagtgctaagttacggctcacgctattgttcatttttagaggagcgaattttcgaaaaaggaatttggtgagtttgttctgatcagcagcgcataataacaatgcgcaaaaactgaccatttgtcggccagagcgtctaccgaacgtatcctatggcactaccctttccatcaactttccacaacatcccgtaacacctatgagaggtcgtagagttctctgcatctttctagtaggtgttcaatcaatcatcctttcccattccccagctttcgcaaggacgtggccaggacagctctcgatatttttgatcaatattttcacacatttttttattacttttgaacaaagcaatgtgatgtaattagtatggaaaaagcataattcaaacctaatagagaacgatttctgattttgagtatatgcacttgatccactctgactgaaccaatgaataccgttcagagatttgtttcgctcagactgaacaatttttaggaaaaaaaaaatcattcaatgctcgtacagtcaaacttgatttaatataatatcatgtattccaaggttgaacaacgcataattggcgtttataccgtgatgcgccctaatttcgcgcacttaattttcatcaagatatttttccttctcaaaataatttgcgaagtcaatgattgaaatttactattggattacacagtctaagtaaagtaattaattaaaaaaatataacttgcgaaatttgcaagccaattgtataactcctagcaaacaaataaatgaaactagaagtgcctaatttcgctcacaaaaatcaagtagttcctaatttcgctcaaaatggttccaaatttcgctcacgagaaaaacgttttaattgaatgtatatgattgtaagtataaataggttgtcatttttattaaatgaagaatgaaatatagcattcaagaaacagttttatttaattctgaacacaagtatactgaacactgactcatttttctatcaattaatcagttcgatgctgaagaagttggtcaaactttttcttgaggacatttttttcttttcagctttcttcagttgcttttcgatcttcttttttttttagttaactcctcttcttgtttttgcttctcaactttttcaatgaactccttataagcctttccggtggctacggcaggaggacgaattttgttcttcttaggtttggaaatctggtggggcccatatagccttagcggtaaacgcgcagctattcagcaagaccaagctgagggtcgtgggttcgaatcccactggtcgaggatcttttcgggttggaaattttctcgacttcccagggcatagagtatcttcgtacctgccacacgatatacacatgcaaaaatggtcattggcatagtaagctctcagttaataactgtggaagtgctcataagaacactaagctgagattcaggctctgtcccagtggggacgtaatgccgaaaaagaagaaggtttggaaatctgtgctgcacgtggttttggaaatgcttcggttaaaacatccgtagtagtttgggtgttcttcagcttattgcgacaattttgatctaaataagaaagagcaaaatgattttatgattgtaataaattatgtatttgtaatttcacctttaacatcagcgtcagtcgcttgagaatccggaaaacccaaaaactgaggttcctcgtcttctgacagctgcgctgttgttactgtctcaacaatagattctggattttccaatgcattcgtattgtttctcattcgcttccacactgcaaacaaactcgtatcttctatcggtccagtccaatttcgtgttgttagattttgcttgaaacatttcaattgctgcggtgacaagtaggattctaactgatcaatagcagattcttgaaggctatcagtcttggctgatgaaggcaattccggcaacggaggagacggatctgtggcaacaatgtttccagatgtcaatgaactatagtctactgaattaaggtcaaacggataaagtccacaacgctacattgccaacaattggttgacgtacaggaaataatgaggtataccctgtgtttatttgctcaagaatagcttgaattttgtctaacatcccaaggttcctcaaaccttacagttatttcgtgtccaaaaaattgctccccatttccaaaaattttattagtctcctaaagaagaccgtacaattaggaaatttctcataaaggcaataaataggttttgaattttgacttggctgaaaatatttaaagatttacaaagttgaaggaatcattgaaatttatgtgaattaagatatttcatgtcatcaacgtttcaagaaattccgtaaatctcatctttctatttatgaaaaacagcgcatttgcccgaaattctacacgtcgaatggtccaggaattgaacaaccacgttcaatgaaacaccgcaatgttatctcccatgagattgaagtaaaaagggagaagaaccgcggttgtttctctcctctggcgggaacgccgcgtgttctgttgagcaaatgcgctaatcacgaagttagttctttctgatcccttttctttagaaaggaggcgtttgttgtatattcgcttgctacgaccaaacaacgatttccatcacagaattgccaatgaacccgttttcctcattgttctacattagccctgttgttacgcgcgtggacttgacgatagagagatcgctcgttcgattccgtatgctggttttgtttgtgctttattttttttttaaagcttataatctgtcgacaataaaaatgatatttttgttgaacgaaaattctaccatagcgaaggaagcttatttgttcgtcaagcctatgtaacggatcactgcagcaaatagtcatccaacgcttgaatgactaagacgattctttcttcagcttcgtcgccgacttttttcatttgacggcgaagactgtccctgatcctcacataacttgcggcccgtgtcatgttttgaaaccattgaagtggcccgtccaagcagtttgactgaggaccactgtcgtagatagcagaaaaatgtgtcgcggttcatccatcctgattcggtcttaccagcagcccatctctccggtaattgcttgaatatgtcaccaggaattcgttgtttgtacggaaatataatcagagtcggtaccaacagccctgaagcatttgctccaaataaggctgtgtatgcttctttttctgaaattccaactcttgcatgtacataccggcttccgactcccgccaagacaacttccttagttggaacagtgcaaatcgcggtttcgtccatattaaaaattctggttggatcttgcaatatctgttgatgtccctctgactcaacaaaatctaatatttccgaaaaccatgatctgatttgcccttccgtaacaacaatagaaataataaaccatagaagaataatgtcgctggtgttccctttgttctcgctcagaaacatgttgggtacataagtgtcaaactgcatacaatttcgcgttgacatttatagccccgcctatctcctccagcaaaagatgttcctactgcgacgccagcgacattcttcttctatggtttattacttctattgtaacaacggctcgatattttgggagaacgctagggatacggaggacaatgtttggatgacgttttagaaaaagttgaatccattttctgccgggaacgccattcttgaaattattgcttactttacactttttaacataatatgccacgcaagctctcaatgaccgtgtacataaggtaaaaaggtgtaatacgccccccttaaggaaatactgctctatcgcagaagcaaatgcatcacttctaaacttttttatgtcaaggtgttccttatttagttggtcatgctctgcacgcaactttctctttccaggttgcttcaaaaaagcgtttaagatgttttttttgtaaacggccccaatgtttacgtttcaaaacaacccgggcaatatgcccctcccatagaaaaaaggttcacggcgttgtagaaatgtttgtaaagagaattctaccacttgcacaccttaaaggggtcatttagcggtcttcttccggtaaaagtttttgtaataagtacaatagtaaaggatgggcttcatttacggtgaggcttgcttatcggacgcataattttacgccaaaaacctgattttcgatatatatagaatttctattgattgttcatacttctcaaagaacatatatgcagaacatcattttttcgcgaatattcaagatatgtgatcatatttacgtgtaaaagaagcctcaatcccgtgaaaatgaagaggggcgtattgccccgttggggcgcattacaccgagttaccctacaggaaaaccagctctcgccatatccagcacccaattgacagcatagttctcgatacttgcggtcagcactgtgggggctccaagtcttgattgaggatgattgcacttaagcttgtccctcaatgtaatagaagtaataaaccatagaagaagaatgtcgctggcgtcgcagtaggaacatcttttgctggaggagataggcggggctataaatgtcaacgcgaaattgtatgcagtttgacacttatgtacccaacatgtttctgagcgagaacaaagggaacaccagcgacattattcttctatggtttattatttctattctcaatgtactaaccggtaatccataatggatcatttgcagcgccgcagaaactttatgctgcatatgctttttaggaggcattctaaaacgcaaacaaaaacaacgatcgaaattaggctttgtcaaatattcaagctccaaatttcgtgcacaatattaagatcaaaattatcagcaaatacctcgtttttcattcaatatttaagtaatagagctttgacctacctgctagatgtagcttaagtgttttccaggattgaaacaaatctctttacgacacaaaacttaatattccgcgcgcgacggcgttcgtgctgttgctaacgtagacacaaatatggcgttcaaacaaagtgtgttgttttcatatttgttttttttttcataccgatttctttgtgcaactgtagtttttatgaaatagtgttaagaactgttgagtgttcctattagtacctaaattacgataatattgctgcttattccatataaataaaaatttcatcacgatggtgagcgaagtttggagctgcgcgaaattagggcgcatcacggtagtacgcttcgccagtagtgaccttcggcagcggaagtgttttttttgcaaatcaaacgaaataacgactgtatcacaatcgtttgcttgatcagcatcattggatcgacttttaatcaacaaatcgacttgcgacaaatgttcttccttaatcttttttcgatcatcaacttcttccgaatcgccgtttgtagtcgaaagtgcttcgatttgaactttgatgctgtcacataccttacaagtgtcctttttcggtttcttgaatttaaggacatagtgcttgtgaaaaactcttttgtaagttgcgaaacttatactgttcacttcgggtgcggtttgctgctcgtttctaatccaatcttcatacaacgtgaacattttggtaatgttcaagtcttctgtggtgtgggcgtgaatcttttttgatcgcagcttcttctggaggtcatagtaggcccgacttccactgatgatgcgcctccgtatttcacggctaacattacagtatggcccataaaaaatgcgaaaattgttcgaacgtgaatttagcatccacaggggttattttcattgcttttgatagtgaaagtgatttctgattattgtagtatattctgacacaactatcgctatccaggacaatttttcttactatcctaaatgatgcaataaagcaaataagttcaaaggttttgtccgcccatagctagaaacagcgtctaattgtcgtataccgtgaaggcacttaactctgcgcactttcaccaaaatccaccaaaatctggtaaaatacttacatttttgttcaaaatttatttttattttttatctagttcgtttatttgaggctcaaatgcgtttaacgctttacggagccgaaattcattttttgtatttttattacatacaattaattggctttttcaacattaatatgggatggagccagggtactcgtggcagctcgaggttagtggtcacaatttttgaaggaaggacatggtagggattggaatcagagttctctgcagctcatccgggaggtataacgtggcatcttgattttcgtttcatggcgttggtagcgatttcttgccggtattcgactgccggatggccaggatcctcaatccaacacaaagtggacaaaacacaaaaaaaaaactgggaaagagaacacaagagaattaaacttttatacaagacgagcgaagaaaatcgtaaaaaaaatatttttcatatattgctacaatagtaatgaaaaagcacacgaagaattttcttgacaaatttatgtttgttacttagcatagcatagactgactgtacatgtcaatggttgctactccgtgattgatcggaactggtaagaattgcactacgatccaaatgaataagggatgggagtttccgcttactctcgaagtgcaattttagcagatctaatattattgatcaataacggcgccggccaagtccttacagtcagttgggatggggaaggaatgttagggtgtaatgattgttgcttcaagagaccgagaatacctctgcatctccacaatcaccacgggaagggtgtttattagcaagggaggagaagatctgggagtcacctctggtcgcatcaccgaccatggacaagggggaaatataggacttgtatttaaagctagttttgtatttttgtctcgagaagtttttggaaaaaatacgtcaacatctataatgtcgaacaattcaaaagacgtttttattaatgacgaaaactgaaaattgcatgtatatattttaacttatatgaaacaggaataatgccgacacttgtagtgacgaaccatacatagtttgtttgaaaattacatatgagtattaaagtgcattttgtctcgatatggtagaagttttagaaaatacgtcaacattcactatgtcgaacaattcaaaagataatttttaataatgtcaaaaagagaaaaatatatgtttgtttgtttgtttgttttgttttatttacgacattttacaccgcttggtgcattcatgtcgaaagctaaatttacattattttttcttagacctggtattataaactttccattcagattcgataaattcttcttccactgttctctcacattcctggtcaccctggttgcacgttcgctttggttggttatcttctttcgtgctgctagacgtttccgttgacaaccgccttttagttttgcctgcagattcttgctcgaaatcggtttcatttgcgctactaccgtcgtcatcgttgttgtcgttctgttcatcggattcgcttgcagccgggggtccatctgctataacgtgctggtgttcgtcgatcgtcgtacggtctgtaggagcgtttgctggttgttgttgttgttgcgttttatgagtcggatttgtgtttgggtaagagacgaatgtgcgctcattgttgatcacgatgtacggcggcacttttttctccatcctcattcgtactactctgactccgttcggcacccccttgaagtaatttttccatacctcattgtggatggagataattttgccgtactgctccatatgatcccaaatgacggtattcgacatctgcggcgggaggtcatggatccttactgtagtagtaggcccatctacgtagataggaatatagtacttcaatccctcgcgaatgaagcagtgttggagatggtgttgtttttgtagccgcggggctacaccggcatcgttcatctcgatgaaaacgcaacttttgagggtatgcaattgtatattcctcacgtccgccatgtcgagcttgacgaatttttggaggaattcttccacctgctcgattgcgggccttttcggcaggacactgaagtccacgacgagcgtattttttctgtgtgaatgcattttgcattgaatgcaaaagattcacagcagaaaaacgtaagagagaataataacttcactaggtgtgcacgagcttgcgaaaagacgtgtatcgcgcgcgaagaacggttgtcaactggaaaaatatatgtatattgaaattgtataagaaaaaagcataatgccgacacttatagtgacaaaccatacagattttgttttaatattacataaaagttacgctttcaagaaaaaatgtgttagggaaggtgttccagtattcgccatgtaccagttattcgccatcccagattttataccgttttactacatatatggttgccaattatttagtgttcgctaaattgctttaagatgatacggaaacatttttagaaaccgcaaaattttctcagaaaataatagaaaaaaatcattttccttaaaatttttgctcttcttcttcttctttctggcgttacgtccctactgggacagagcctgcttctcagcttagtgttcaatgagcacttccacagtcattaactgagagcttactatgccaatgaccatttttgcatgtgtacatcgtgtggcaggtacgaagatactctatgccctgggaagtcgagaaaatttccaacccgaaaagatcctcgaccggtgggattcgaacccacgaccctcagcttggtgttgctgaatagctgcgcgtttaccgctacggctatttttgctcctttgcacctatttttcgccacctgttcctgattcgccaccctccataagaaatcaacgtaagtggcgaattcaggaaccgaaattaaaatcgtggcgaatactggtgcaaatggtccagtattcgccaccaccatttttaatacagaaacaaagtttctgattagtttttatattttccctactgaacatggattgaaagctttcgtttgatgtattgacagtaaccaaaggtcttttgattcataaataaacaatatttttccttagggtggccaaaactggtacatttaccctatcataagcatgaaacgaactcaccagttggtaatccattctcgactgaacacaaaactgacactgacagcaaaacttcttggcgtcccgaaaacaaaccgtctttcttgggccttcccaaatacgtacccagcaagacgctccaaaacaggaaaaaaaaaaatctccggcgacgaaaacacgcgcgaaaccgtcagcaaaatcaatcggacgacgcaaaaccgaactgttctgcttgggcttcacgaagcactaccttgacaaatttacgtttgttactttaataaaaaataaaatagctttaaaaatattgaaaaacttccaaattgactgcccgttagcaaaaatgctaagggagtacctcatcacttaagggggcaggatccgtcattgatctctgaattttcaaaagcagttttttcgttcaaaatcaagaaaatttacaggaaaatgtgttcactgtattccattctccaaacgaaacacagtgaccacattttcatcgaataatttttagttatgaacagaaaaactgcttttgaagtttcattgatgacgacgattacgatgacggagcgttgatcgttaagtcatttcctcgtgcgttaaaatacactcaaataaagatttaaaaaaaaaaaaaaaaaaacttaagtcatttgaagcaaattaaagagaatatattttcgatttttagtacgtaggctctagtttatttatcgagcaatcatcactgataaagtgcaacttattttctctccattttcttattcttcttaagtgcgcatagtaaggaaccatttttcaactatgttccttactttgcgcagcagttataaaacgttattttcaacaaacaatcaaccctccagaggtcggtattgaagggaaccatcgacttgtcgacaccatcgagatatggaatagaaatgctttggaaaattgtttgaggggaccatcatggtaagggaagattaaaaaatgacctccatcttatttaaaggatttctacactccgtcccctcaatcccctgtcgcgatttttacagtacctaatgcatgcattgtaacattttcatagactccaccttcccgtgaacgatggatgtaatttttaaatgctccctaaccatgcaataaaataattttgattttttgtatagtttcatgagtcaatatcgagtaatgggacatcgaggtttaatcgcatttgcaacatagaaacgcctataaagtgctgttattgatctgcaataggaatcgttcattaattacgtcacgcttatacagagcggcgatacttttcgattgagtgatgaacactacattaagaatggatatacccttacgcttaaactattcttcgtatttagtagaaatgttcgggtttcacatataacaaaccagcaccaggttcttatttattttcttcaaacccggatccgacacgaatcgagacaataatttgataccaaacccggacccgaaccgaaccaaagaatcttttgttttatatttgctagtgaaaatacataaacagtcaaagcttattttcccttacacgccaagggtgaatgcaaaaaaagacatagtttgtacctttttgtatgttggtttaggttttagaaaactaagttaattacatgttttggaaatcatatgatgatttcgattgttttgagagttgcacttaatggcattcaattgagttatagataaaattcacttcacttagtaaacttgtgttagagacattccacgctccactgggaacgtaagaaaatgaagagaaattcggagtttaaatgctagtaatgctattagtaaaacacttcaactgttataaagaatttatcgagtgcgcagagttaggaacacggacacccttgagaaaaattaaaaatttgcaataaaaatcattacttagtgaagcttttatattttttccttatacataagatcaatgagtatttgcttccaaaatttcagaatattgttttttgttttcaattaattacagctgtttgaaatttaaaaagccttaattgcgcagagtatggggccttcacggtatttcatatctttttctattttctctctaccatccaccttctaggagtggctccaacaaggttgaggaagccgtagaatgctaccaacgggcggccaacatgttcaagatggccaagaagtgggcccaagccggatcagcgttctgcgaggcggccaatcttcatgccaaggccggcagccgtcatgatgcggccaccaacttcgtcgatgcgtccaactgctacaagaaggtgagttggcattttgaagtaaacaggatgcctatacattctggggaaacgggaaaaaattcggatattctgaaggtttgaagtttgaatataaaaactgaaatacacctcgtagttttgcgtaacgtttctaaaggacttatctatcattgagaggctctctttgtttactttgtctttcattaataactgcgtttttttgtatgaaacgctagtcaaggaaattgcctttcgatctatagtgaaaaacttagtattccactgttataatcgaaagagaacgagagaggagagaatgtttcatttgtgcataggtcctttagtaatgttcagcgagatatattcaatagaaccaattttgaccaactgtatgaactgttttactgtagagttgttgaattactctaattgttatcattttttttcgtagaccgatccaaacgaagccgttagctgtctgttgaaggctatcgacatttacaccgatatgggtcgattcaccatggctgccaagcaccatcagagcattgcagagatgtacgaaaacgaggcaaatgatttggtaggttttccaaagaagaataccctttttagaataccaattaacatcattttgtgtctcgccctctagcaacgtgccgtgcagcactacgagcaagcggcggattacttcaagggcgaagaatcgaccagctctgccaacaaatgcatgctgaaggtagcccagtacgcggctcagcttgaggactacgagaaggccatccagatctacgagcaggtcgctggctcctgtctggacagctccctgctgaagtacagcgccaaggagtacttcttccgggctgctttgtgccatctcagcgtggatctgctgaatgcccagcacgctctcgaaaagtacgcacaacagtacccggcgttccaggattcgcgagagtacaagctggttaaggtgagttttggttctacagcatttgttagaaatatttttcccagaatctcatatcccataatggcatcactccccaaaaggcttacctatccaaatttttaaaatttattgaaaaactagcttcattaatttcgaccgtttcaccatttggccgttcggttcgtttgataaaccgctgcacaccaagctcttatggtgaatttcaccgtaatctcaacagctgaacagttcggtgaaagaaaacaccataacttcgtcggaatttgacggactccggtgattttttacggaatactgtaaaaatttaccttacttcgttaatttattttaccgaactgttcagctgttgagatttcacaggaatccgtaaaacaatttaagtgtgtagggtagaaaatagtgatgaaccgaatattgatatccgactaggtattcagtgcttataaagtaaaattatggttagtaaatgctgggcatggcgtaccattggtacctcgcgtatctgaaggaataaaatagacccctctgtgattcttagcctcctgcttagcaactcctatccctacctcctcacggtactggccggggtacgagcaaccttagggaagatcaaatagctaaccccggtgggaaccttgatcgtatgttaacaggaaagggggaggggtttgcttttgcaaacctggagcatgtgttccccatgtcagggacggctgatcatcgtccgagtgccagagaaggactctaagctaaactgcgcactatggccctccgaacatttaggaggaatggtcctccggaaatcttgggggttggtgtcaggccctgcaaggtaatcgtaaaaatacaccagctcaggaacgtcaacgagagaatacggaccaaaacaatcggcatagaccacagcgacgaaaatggactagcgattggaaactcggtacgtggaactgaaaatctctcaactttatcggaagcacacgcatactctacaatgtactgaagatccgcggtttcggcatcgtagcgctgcaggaggtgtgctggacaggttcgatggtgtcaacgttttgaggttatcataccatctaccagcatcataaacgtgcatagccctcactcaggaagcactgatgatgacaaggacgcattttacgcgcaatatgaccgctgcccaagccacgacgtcaagatcatcataggtgatttaaacgctcagattggccaggaggaggagttcagaccgacgattggaaagttcagcgcccaccggctgacgaacgagaacggcctacgactgatagatgttgccgccgcctccaagaacatggccattcgtagcacctattttcagcacctatctagtgatggtgaagctgcgcccaaaactatccgtcatgaacaatgtacggtattgacgcctgcctcggtataacctagcgcgactggcccaaccgaacgtcgccgccgcatacgcgcatcatctcgaggtagagttgccgggggagggtaagcttgacgaagtccctcttgaggactgctggactaacatagaagcagccatcaacaacgcagccgagagcatcatcggatacgtggaaaggaggacatgtaagaacggaatcatcttgacggacggacgtgaggtgattgaaaggtggaagcagcactacgatgaacacctgaatggcacacggagaacacaggcgcaaagggtcacgacagcggaagaagtgactacgtcagcacggcggatgaaggagggaacttaaggacgccatcaaccagctcaagaacaacaaggccgctggtaaggatggtattggagctgaactcatcaaaatgggcccggagaggttggccacctgtctgcactggctctgacacatgtgatggtctgggggtgttttccatggaatggagtaggaagcctcgaaaaaatcgacgaaataatgacggcagattcctacattaacattttgtgggaaaatctggaggtttcgctgatccagacgggccttgaagagaaattcatatttctctagaacaacgacccgaagcatactaccaagaagaccaagtctttcttccggtcttgtcggattaaaccgctggaatggcctccacaaagcccagacctcaaccccatcgagaatcaccttggtaaggaaaagtggaaattcccaagggtattgattggccaatttcaaatgtaaactatagcacttcaatgtttgtgagttcagttttgagtgcaacttcttgatactggatcgtaaatattctgattccattttcttaataatgtcctgggggacctgacctctaaccttaattttatgactctttggggtgagattaagcttacgacactcacttaaaaatgctatgtcctttttttaaccctgcgatcgacttcttcagcttgataaaagtatttgattcggaaagcgtggaagccattacaactctttaatgaaagttcgaatcctctgagcagaatctcaaatagagaaactttaaagtagatggagtaccgtgtaccttttaattccgctcctaaatgcttatctttgacagatacgcgtatttcgactaccacttgcagtcttcttcagtgtcagttactcgtatccactttcattaaagagtactaaacttgcatcagcaattattttatttgctgaaaaacagcaggacagcaaaacagcaacaggaatggcagacggtactttgcctctacctataagtcctaaccctttccccaacggcgcagaaacatggtgttgatgtttggttttgttaaataaattctaatggcatgttacgcaattgaatgttatgtaatttctataaaaatgatgttgaaatgaacaatacctatattttagaccaaccaagtgctggcggctcggaatttctggaaagcagcaagaaataccactaaaataacaaataatcaaatacaagttaatccctctaccggcaatgaatgtttttttagcgctaaaaaataaaactgccggtagaagggttaatcagcaaattcaaacatatattgctggatggtcagcaaaccaaccttgatgaaaatttgaattgctgaaagatccagaaaattttgtattgctggatcgattgctaaatttacagcacaaaaaaaaatcagcaaaaatttgctggtttacagtattgaaaatttgatgagttgcaggcttaatacttctcaacatcatcagagttcggtgacaaactctaaaatagcgtgctgctcttgcctctttgtgagggagcgaaacaattataaacagagaggcaaagaaaattgagcgacaaagatgcagaacagagaaaaaattcaaaaaaaaagggtgccatcacaattctgcgagggctattttgttcgggcgggacactcaagagttctttcaaaatgtgagctaatgtgagcatagcaacaagagagaaagagtagcaaaaaaaatcctcatatttttttgcactctctatctctcgaatcgtttgaggatctgtgttgtatcatcaagatctgtgttaaaacatcaaaatcgcttcatttttgtatcgcagatgagagccggattgctaggacgtgaccagagcaactctcgactgttgaatgatgcgtcaatcttgtccaacagcccatgctaagtttgaaaactctaattgattagcggataggaaggagtcaaaccttattgaatcgtatatgacttgacatctattatgtatcgtaggtgacacactaacactaacataatgccgaaaattcaaccctgaggctattgaaaaacatgtaatagcttcaaaataagtttttaatttatatttcaagcatttaaaaacaaataatttctttttttttggggtcgataaaaacggaataatttgttgacgaaatcggaacgtgacaaaatcgcgtgataaacggaacatacctgtacggccgttatacgcataattgtcccatgttactttttgtgcattttgactttgtcatcaaacagtttatttttacgtatagttttagaaaacatccaccaaaaattaattttgttcggaaactcaatgaaaagcaagccaagtcattttgtcccattgttaaatttccacgcataactgtcccactactgtatttctacgcataactgtcacactatacaattcgctgcgctgaactcgagcaaaatattcagtaggcagttttgaattagctggtgtttgggaaaatcgttttgaacatcttcttatgttggctttacatcccatgtggaacacaacccgtttatgtgaattatcgggatgcattcataattcatgcgagcctaacgtcaaatttgattgaaattttcaaaatcaaaacattattgcgcatccgttttttaattaatttcggttgaattttcagggtcaatcacaaaattcttctagtttttggaatcgcggtcattgattagaattttatcgttattttggattcatcacgggaagtactgaaataatcccacttgaggaatcagtaaccactttaatttcgagtggctggcttgcgaaaaaccaacttcatgatttagcaaacgaagtctaaataaaaatagtttgaccgacattggatgacttggccacatgctgggttgttccgaataccggttcactggtggaagtggccattatattggcgaatatgaaacctggcttgcgacatatcaatgtcaaaggtggataaaatcaagtcttaaggtggttcaaatgtatttgaatgacttgaacacatgtcggattgttccgaattcccggttccttgggggaaatggccactaaactgtcggttctgaaacctaactggcaacattaaacttcataaatttccaaatcaaggctaaagaagtgtaactcaatggttcttagatgacttgataacatgccaggttgttttggataccctgtttcccagagaaagtggctattatattggcggttctgagacttgtgagatatcaaacatgatgaatttgcaaatcaagtcaaaagaagaatagttcaagaggttttagatgacctggccacatactgggttattacggattactggttcttcgttgcaagtggcaaatatgttggcggttcttaaacttaatttgcgatgtatcaaatatcatgattttgcaaaccaagtccaaagaaatgtcaaatcgtgtgatgatttgtatcgtgaattttgagttgaatattatttccgcagaataaccttgaattcgtagatgagtttctgtcaagtctttagctggaagagtcgatataactctctaacacatagccgtagcggtaaacgcgcagctattcagtaagatcaagctgagggtcgtgggttcgaatcccaccggtcgaggatcttttcgggttggaaattttctcgacttcccagggcatagagtatcatcgtacctgccacacgatatacacattcaaaaatggtcatgggcatagtaagctatcagttaataactgtgtaagtgctcataagaacactaaactgagaagcaggctctgtcccagtggggacgtaacgccagagagaagaagaagaaactctctaacttacacatccactctttgtatcactaactcatacattttcttattatcacacatacaaaaaactttgctttccatcccatactataaaatcgtatttcttcacttcccccacgtggctccgtttggcacatgtcacttgagccttcattagatgccttaacatagtcctgaggttatacgtcctctccattcggtacaatatatacgtaagaacggtcatctacagcagtatgcttagcacataattggtcactactttcagtgggactgttatgcgtagaaattgaccaaaatctcgtatttctaggcataacagtcccactttgaatttcgtagctaaatttactttattcccataataaaaactcttgactctaatgaacacactattctttatactattgtaatgattttaatttaatttaccccacatctggtcaatacgaggcctaaatgtgttaaaatctttaaacgcgtttttctcgattgcatattttggaacatgggacagttatgcgtataacggcagtgtattgggttaaaaatgtaaacttgttcgggaaactgaagtctcaggacttcaaactggagatgtatcgacatacatttttgggtcaaagtacgctatattaaagtgattataaataagcccaactttaaatttttaagttcaatacacattatatcgggtaagggaaacatgattgtattgttctcagtacttgtaaacgtttttttgcatcgtgttgtcaaacaaatatggaaatatgtatccaaaacaggctgtggtatgaatggggatgcttttcaagtaccgtaaaatggggggtagttgatcacttttgagagattctgctctgtaacttttaataggatgcgtgtattgttatccaaatatttttaaaacctgtactggttggatgtgtatcgaattacacaaacgaaattgtgacgaaaggttctcgtagtaactaaaaaaatatttagaaatcaaaaattggagtttttgattccggggtgaagttgatcaatttttgtgataggtttcctaaaataatgaagtatgatattcactaaatttgaggccactgaacatgaatcgagtatcaaaaatctaacaacttgttgatttaccggtcagttttaggtttgaatgctaagaattgcagaatacaccacattaaacgcctaaaggtatgcaattttctttgaaattaacaactcgctcacaaaatatacatttttttttctcgtaaaatgattttttatccacaatgcaaattcaaaactggattcacagaacatatctggaatgtatgaaatggtttatttaaatggtgtcttcatatagccttgacaataatcgattgtttgaagaagaacccttcaacagttcatcaaacatttccttaaaaatctgtttttccgtggtataattatcttgaatatcaaatagaatttaggaacatcaagagcagttgtcaggctatgcgacatcacataaattgtgctgattgaaatcaaattatagctctattgacagtttatacatgtgggtatgtgaatgatcaacttctccccactgatcaactacaccccgaattacggtagctgtttttgttgttcccttttttatgtggtctaccgtatttcttagcttttttcgatgactttttcttgagcacaacagaaacaaaggcaccatccatcaataatactacttctgtgattttcaaacaagtcgaaaagagtttcacggggtgtagcttatgaaatagactgactgctcgttgaaaatccggaggtccgtattgaaccacatcaaaaggtccggattggaccaacacgtattttgaagtttcaagattttcaagttagttgagcacaaacagtgcatagacatatcaagaccatatggtcagataaaagcttaggcttgaggggttctattataaaataacactgaaagattgtagatttcttgtcaattacagaagcttagaagtaatgctaaccgatagcacattagagcacttcaaagcaacaaactaatataaaaaacaaacgaattaaatgaaaggcgtcaaatgtattgtgctagatcctggctagacggtgggtagaaaaaagatacaaacgatctttacaatagcgccagtattgagaaatgcttgatggtccaaaatagaacagggtccgaattggaccagcttcccctaataaaattgttattacgcagctgaaaggtgatccaaatctctgcaattgttatcgttataattaatcaatactgatactgcgaaaatcaaataaataaaataaattgaattgatgaaaataactttcatcaaatttctcagtacaaaacatgactggaatctacgggtctactttttgttaatatacttttgatacaattttttgctcaaactgagtttgaacaacgaagttgttggtctaatggctaccgtttctgcttcataagcagaaggtcatgtgttcaatcccaggcccgtccctttcctcgtactttgtagttgtatctttcactctcttctatctaccgctcttaatatataacagttgatctatcacagttcatagcatttgctagaacccgagacggacagaaataaaccgtttccctacgcttccattctctcatcattttagtatgcctatccttacgcctgatacataggcagtctgctaaccaaactgcaagcttctctgccataaaaaataccccaccccttcacccttcccgcataaactggcgtagacgcagtggaatatacggtctaccgtgggagccagtagattgcatcatcaattccttccccgtcccctcattggtctgcattctgacgtggcaggcatcattgttgcttaaaaatagaagatcactagcacttatacactgagggtgtctgttagtcccaagctgtcatctggctggttccttgtgtaagtgcagctgatctggcgatactggagtagcaaccaagggcagccaatcaagcttaatttttttttttttttttccttagatttatttggctttacttataataacacatagcctgccaagtggtaattcaagtatagtactatatatcaacctcacatgcgataataaaattggctattgtctttaaaacttctaaatcttgttccctaagtattacttgcaaatctggaattatttgttttctaattaacatcgtccacaatgtacgcctttgattgaggaatctagtgcatccgaatattatgtgatccggatcgcaaggtgcttcaccacaggaacatgaatcatcctcaattatcctattccgtttgagatgggctggcaaacgtgaatgattactgatgagtttagacagtataaccacctgtcttcgatttaaattactatctacgaaccacggtagttgtgaagtagtaggaagtatgctgtgacagaaacgacccatcattccatccctccagttattctgccagatatgcattccctgttgcttcgccggatactttacatcaaaataagtcagtcgatgaggttgttcgactccactaatacacgctgcttttgctaattcatcagcctcttcgttcattataactccgctatgagctgggacccacaaaaatgataattcagatccttcaaattcagctagacgtactgcctgctttacttcgaaccacgccattggagtcgatgaatctaccgattgggtttgaagactttttagggcactcatgctatcggtcatgacaacatatttacccatgggagcttctttgatgaggcgaactgcgtcgagtatcgcaaataactcagccatatacactgatatattgtgcggtaatttcacactaacacaaggtgcaccaaaattgttaacaacggcatatcctgttccatctacacttttggatccatcagtagcacatacactgaatccattgtacgattttaccatttctctttgaactaggtcatttgcaggaagatccgtagattgtttcatagccgcctgaatgctgaagttaatagaaagacgtttgctccttacggtagagccaacgaggaaacatggtagatttggaagggtatgattccatggaaagaattctcgtaaacgaataactgcatctctcagaggagatctcgatgactctatggcatgtcgtgttgcaaattgtctctcccaaggagcgagaccaatcctcttgttgacgaaccgcaagatagctacgtctcgacgaatttcaagaggggttaagcccgccatgacttccagagaacctgtatgtgtagttttagttgatccgaggcaaatccgtatgcaggcatactgaatgcggtccaatgctaaagcatccctttttggaatgtttcttaagaacactgcaccatattcgagaattggccgcacgcacgatttgtagatttggagcatggtttgagggtgcgcaccccagtattgaccagcgatacttctaaggaaattgacatagggcagtgaacgttgcttcagatgtgctatatggcgagaccatgacagtttcgatgttaggaagatgcctagtagtttcatcgactctacacaaggtattgtttcttctccaatatggatttgcggctcttcctccaagggttgttttgagattaccataacgctgcacttcggagacgatatttcaagccctagtttcgataggtcattcaccacaccattcaatccagcttgtagattcgcacttgtttcttctagctgttttccgcgaactgcaatggtaacgtcgtcagcataacccactttgatgacaccgcgagggatattgttcatcatcctggtgatgaaaatgttgaagcaaacaggactcaatggcgaaccttgtggaagccctttccaggttgttcgataaatttgttgatgatcgtttgtcgtagctacaatcactctctctcgaaatagccagtaaactgccttgattacgcattcttcgatgtcaatcgctctcatttctgcgaccaagcaatcgatgtctacgttgtcgtatgcacttttaatgtcaacactacatatcagcatatgctcacgattttgtaatgcccggtaggattcctcaactatgatgttggctgcatcaatggtgcctttccccttacgaaatccgcacatttcgaatgggaaaagttgcatgttctcaatccgccattctacccttcctttgagtagcatttcatatgttttacggaagcaggacgctaaagctattggacgaatcgatgaagaagaattcacctgttgccccgattttgggatagctacgatttgaaacaggttccactcactaactgttccctccttctcgaatgtttcattgtagattttcagcaaggctcgtaatccaacaaacggtaggtgtgcaatagcagaatacggtacaccatctatgcctggagccgaatccttcccggttttcatgacagactgtagatcacacattgagaaaaagttgccctcaatatgatcctcacaagtgcaatctgaaaactgcatgggactattcggcatactcgtaggggctaatttttccagcaactcttccaaaacaggttggggtatacactctcgtcctcctgatgaagcgcgccctttgtatcgacgtgccatcttccacagcgtgttgactgaagtagttccatcaagtccgtcacagaattttcgccagctggcagttttcttttccttaatcatcttcctaaaccttagctctgccgcattataatcgtcataagcgtcttgtgtcagcatccgtttccaagctttgaaagctgttctagtctcctgtttggcagcagcaagttcatcgtcccaatatggttgcggaatcttcatcttgtcagttcttggagaggggattggtgcggaatgtgtcagagcattccataccagacgaaagaatcggataggatccaacgaccctgtgtatgcggcaaggtcgtcttcaatcttcttagcgtaagtctcccaattgatttttctccagttcaatttgctacgcctttggtccactgtggttcccagtaatccaaatacgatagggaaatgatcgcttcccgttgggttctcctggacttcccagtcaaacatcaagctcagttcgggtgagactatggtgatatcaattgcactccacgaattatttgcgtcgtagcgagttgcatcaccgttgttaagtacaatgagattttcgctttctaaagcatcatataaacatcgacctcgttgattttctgtattattgccccatagcgggtgtttcgcattaaaatccccaccaatgacgcaaggttttggtacggaccgaagaaaatgagctaatccgttttccgaaacattagcttgtgggtggatgtacacagacaccaccgtgattactcctagactagttctgagttggcaggatatatgttgaatatcaacgggaacgtttagttggaatgcggtggggtgtagttctttccgaatcgccagcgcaactcccattgagttgctccgatgatccttgcgaaatatagaatgattgggcaagttgaagtacatagtattatcaagatgtgtttcattcaggaaaattatgttgcattctaattcattgataaggttgatcagtaccgagcgtttacgaagtaaacctcggcaattccattgaaggcagcgtagtgattcggtattcattgagtcagctggtgtggagcattatcataaccttaaagtatcaaggtattttttgacacggtcgttgaccagctcagtgatccttcccagaacatgctctcgaattttagctcttgattcctggtcttcgggtgcaacctccaaaacttccgccattacctccattacctcgttcgattcgataccagactgaattgatttacagaccccttccgaaatatgtacctcgagttggggcagctcatcgtcacagtcagtatccctcaaacggcgctttgggggtggagcactagtggttgcaaggttattggtagccgatgctcgaggatctgagtgaacctccgcatgtcgagtgttttgaacattattctgcataacgttagaatccgcttcctcgggagccaatgtgcaaaaccagtccgtacgcccttgggagtaggtagactgacgttcagcatcctcctgctttttagcgattattttctggcaccgtcgatggtcgtttgccttgtgatcaccatgacaattgacgcattgaggcgtttcttggccacaattgtgatcagaatcaatgtttccttccagacagctgggacagcgaatagcacttttgcagttttttctgtcgtgacctaaccgccaacaattagtgcattgacgagtagggtacacatagggattaactccatacagtacctgatttatctcgacgtgggacggaagggttaaaccgtcgaatgttattatgacggtgtacaacagttttgttgatccatcattcgcttttttggttatgcgtctcgtttcgactaccgctgggtttccatcctgaatcaattttgctttgtcgaaggccaccgctgtatttagctcatctgaatcaatttcgggctcgatgtaagctacacctaggcactcgatgaggcgttgggggattgagaatttaatattttcctgctccatgatcaccagttggttggctgcctgacgtgatcgcatcaaaattttcatcttcttttttgtcattggtatggaacgcacataatcccggtcgaatttttggataagcatcttagcgattttggacgccacgatgttgccattagaagattccgcaattaccaggtacggtccagtgtaagcttcgttgtagtttctaatccgccgctttggccggttggtatcatcaccggtgtccggcattgtaccgctcaacagaagagttgagacaatgcaaggggttgatataagggatagaaacaaatacgattgttattgacttgctatacagagcgaacgatatcgatgtgatacgtaccgatgcacaaacaagactgaagcttaattttttgttcaaactgagtttgattctagaaatgtgttgttgatgtgattttgatatcattactacaagacaaaaaatgtgagcagggattaaggaggaatgcttttagaaggacgagcgcaaaaatctcatgaaaaatgtgacagaaggatgccttgtaattccgtttaaacttattcatcatataaaaaagttgtaaaataaagatgttttttttttgggaagacgcattctggggagtggaattctggagaacggttatctggggaatgttgtacaatcgtatgtttcggtttattgatattttgaattacattttgattgattgaatctattcccaacagacgctatgtgagcacctggaagagcagaacgtagacggtttcaccgaagcggttaaggattacgatagcatttctcggctggatcaatggtacaccaccatcctgctgagaatcaaaaagcaagccaacgataatcccgatctgcgataaattgccagacgacacgcgattgcactggaactgcagaaaagacgcgttcaaccccatcttactctatcaagcaaaatataattactaaactacaactactatcagcagaatttgttcgactcgaaatggatatttcttataggatattgaagaacgtggaacaagcagcaaagagaaggtaaatttaccaaccaatcgatggatgtgcgcgaggtctaatgcaaaatgacggcgaaacggtgttgtagaattgcaatcgtttttaactcctagtttccaatattatatactatcgattatattcagagctctagcattaaggcaaaagactttacatgaatgagaaatattattcacagaaagaaggataacaaacataacactttatcagattgtggcacgagcgagttttcgttttttatgtttgtttaacgcggagctatcattccgtttatgttgttaaagcgaaggaaatgttacagttattcaattgcagattttgtttaacgcctttgttgtgtaaagtaacaagaatacaaagttagtgaaactgacatacaaatttgacttaaatatatgaacagaacatatttagtgtgtaaacgcgttccaaccattaaaagcaagaagcagtgaaataaatgaaaaacagcgcagaacaataaatcaatacttttagttctatctcacacactagtcagaaatcatagcgaaagataaattccaagcagagaaacaattatcactactaatcgaaattccgatgaatgcactctaaaaagtaaagcagaaaattgtctttaaaaatatatatcataaaaaagcttcgaaataaagcgtcgttattcacacaaaaaaacattaatctaccacagaaaccagagagaagaaccgaaagaaacctacccactttactgttaagtataggcaaacattttatctcctagctatcctagtaaatttgagaaaaaaaggtaaaagaaaccttcaatcgggggttttagtaaaacaattgaaaataatctgaatcgtatcgaaattacaacagttctcgtaaccaacacttaattcagcgaaaataggaactactaaaccggcaggtgcaatgctgaaggaagttgtattttttttccaatggtgggaagctagtgaatttgtgcgagcaagtacattactaataatggtaaaccaacaactaaaacccaattacgtgttttcgaattgcaataaaataaagacaaccgacacaaacggtactacgaaatagaaccactgtttcacgagaattttggaacgaaaaagaaccccatttttgccgatttttcccatatcttaagagaaaatggctcgtgaattgcgaaaagttggcgtatgcgtggctgctattcaggaagtgcgtctgcgtattgaggattcgaggcacgttcttcaactacagcctgatgcaccgaaaaacgacaaacccgatgacgtgaaggacgcgttttacgaatgtctcgacaagacctatggagaatgcccaaaactttacgtgaaaattgtcatcggcgacgctaatgcgcaggtcggaagcgaggacttcttccgccctatcattggtacagagagccttcactctgttaccaacgacaacggcctacgtttagtgaactttgctgccaccagggggatggctatcagtagcatctactttgcacgcatggatatccccaagcatacctaatcttcaagtgaagatttgtcgagatttctcctgggatttttttcaaatcggctgagaaatgacctcaggaatcgatccctgtacttaaattagatggacatatcatcttacgaccattagcggggcaccgtgggaggctttctaaa

SEQ ID NO: 156 - DNA, 7360 bp, Aedes aegypti
tttgggtacgatcgcggtccggaagttgcttatcagctgaccagtttgctatcgggagcaagtgaacgtgtgcgaagtgttcaagagtacagactgtgggaaccgaatgaaacaagcatcaaacgcgaaacaatttatcgtcataaaggaatacgcggagtaacaagaagatcccaaccgaagagcattaagaaatcgtgaaggaagagttaaaagaaagtcgttgaaaaacaaaacacaagacgaacgatcgattgatcgtgtgtgcgaacgtgcgcgagcccccttctcacccccgccttgaatgcttcgagcccaagcggagtttctgtgagtgtgggaaccccttcaaggaaaataaactgttatgtgtgattaattcagtcgcgcaacgcgaactgtgtgtgtctgtgcacaagtcagtgcccgtgcagtgagtgcctgaagcgccaagtttttcctctcggacactaaccaagaccccccaaatcgttggcccctatgggtgtactgaacgtcgtgatcggttccggtgccggtgcagtagtcgagtgccagccgagttgcaagaagaccaacgacaacatcttctcgcccatcaagaacaagatgaaggtcctgaagaagatcaagaaacggatgggactaggttagtagctttggttttcctctctagcgttaagtgcatcgtctgtagacaacgcttgcagtcagaggcagctgcaatttcccgaacccctcgcgtcgtcaacggtgtgtaacgaactttttccccctagcatcgcgccggttctagttcgttagctctgtctggcggcaagcccggtgggttgcgaagggatgggcgagatgacgcggtgaaagggccttccattcatacttaccgaagcgagccagttcccctttgatgggtgctcactgggttgtaacattattgcgcgccgccgccgactgagcgttgtgtttttttcccgttggaatcggtttgcaccattacctttgccatgttcggccggtataatggggtatagttgaagtgctaacaaaaggggttttgttttctgggacgaatcagttttttagggcttcttcgatgccgaatgaggatttcacttcgcaactctgattaacactgtttgtgggtttcagacgtgtaattagttttctgggagtttgttgatcgagagttgatgaaagtgtttagagagttgatctttgtgatacatggtttcaacaggcctgcatcggtttcacaatgaataatctatagggtaaagaactacttgggcatgggagtttctctgtcacattacctgaaactttgcagtaaaatgcatctcaatacgatgcatgttgtgacacaaaatgagctccgtaaccttaaaaaacccctgcttaagtaaatcaaaagtcaaagaaaaagatcccacaccctatgtagaatttagaattagaattttaactttagaaatgtgacattagctaccatgctcactccattagactcatcaatgtcagcaatatggagacgcatgatactttgaagtcgctagaagtctttcgaaatcccttacaaataagttatttaattgtatttgtagatgaaaattagatggttttacgttcccgtccgttataggtaaagattttggacaaatgtctgtctcttagacgaaattgacgcatctcctaatggtcgagaactgttctggtcacgtcttgacaaagctaaggaattaaaacggattattgactggacacctacctacaccctgcagaaaactcccttcttgtaaagcaaaaccaatcgccttatttaggcttatatgcttattatacggctaatttaaggcatgtcagctgtataatgactactgattacttgggtattttgttttggttttcactgttcaatcgctaaatagcaaaatcatcgggaaaaatcccgcaaaaataacatttttttatcgctgtacaaaatgtttgtatagattgaacgttgacatttgcaagtggcgcagtaccatgtgacgattctatttttcatcggtcgaactgaaaataacgcgtattaaattaaatacaggatttgagctgagaaagcatgaaaaacaccattgccagacacggcctagttgatcacggtccatacaaattttaaaaaaatgtatgggcaaatgaccacaagaaggaggagggggtctggaataggaaaaaaaaaatatcacgtgtttaatggatagcccctaatataaattttccgtcaatgcaaagcacattagctcttaaactcaccagtccatcctgtcggtcatcccgtttcgctagccggacgtccaaatgtgttacgcttccatgcccctggcccaagataacacacaaaaacgtccggatgacgacaacggcgcattcctggctgtttgtaatgtggatgacgataagttaccgccacgtcaattctcggggcctggatctcgatcgccgccattcagttcaagtcgtcgagttacgcacatcggagtttctcaagcgtgcttccttcctggcctcgttgactcctccttccccatgttcagtcggatgaatccccatcagaattcctccggacgtcgcctctaccgtcgagtccagccgccgccgtcactgaactctgtgaataataataataacaaataattaattcgctcatgcgatgtgatataaaatggttttcttccacttgtcgccctgttcgtttgctgctgctccggttcggttcagctcagtccgtttcccggtatgtgcgcctccgtttcacatcaaatttttattgcatttctactggaaacagcggcgacacggaatgatggcggcgatgacggcggcggctattggtgacgacctgccagcagagagaactaacggtgggaacctcgatcgtcttcgtcatccaatctgattattattccgacaccgaagcagctctacagtagttcttgtaacaaggttagccacctccccaatcttgcccccgcggccgtcagtgcagggaaagtgcatctggcggcggagtgcggtgaaatgtcgcacgcgtgcttacaagtcgccgccgaagtgacgcgacggcagcggcggcgacttagacgcgtggcgcgcgatcacaaacataacccagaaatgaaaatccgataatgaaaaacgcaatcaagacgagcgtgctgtatagtcgattgattttcttgattggcgtttccatcgtaccgtcgatccacggttatgtataactcattgatatggatcaatgctgacctcaacacataatttctcattaaatagattttcaataacgccaaacacatttcatctatgccaaatattattctatacagcattgcgatcaattataataggcgcaatatcgtatccactagctacctctcaaataagtttcagtggtagtgctctgattcataataggtgtgggtattgttcgctttacaataatgatcctcctttttcactgaaccacatctataagatgaccaacatacccttagttgatccataactgtggggtgactataaggctcgcgccatagcgaaccgtttcacgcatgaccaccaagaggaaattggaaatagtttttcttcgatcaaaatcagcgactttctcctacaaagcgcagatgttccaacatctgattgtcttcgtcttcttacaatcgaacgcaaagatcgtcatccttcgcgtagacttttcaaattttatgtttcccgaatttcaacccctagaagagatgatggaaaagccagctgtccgcataagcatcggaagacagacttcctttcgccatggaggggtactcctagcatgcagtcggaaagcatagatgaagtagaatcgtaaaaggcgtcccttcgtgcgacgtttgcttcgcattgccttaccgcacgtacctatccagagcaacctctcggtttcggttatttacattttcaatcaacatctgcctctgttctcgcctcgcctcgcccaggacggactacggtctccgaagggatttttgcgtaatggattgcgtcgttttttgggaagaatgtgagggcgtagtgcaaagagctccgttgaacagcgagggtgagcatgcgaaacagtacagatgtatataattaaactatggattttgagagatttggggccctttgggacatgtctggattaaaagcccttcaagatttgggacgattcggcgacagatcgtaatatgcaatacgtgtcactgacgacaaatgatgtttgattcttatcgtacgcgaccacgacgacgacgaagacggcgaacggaagccattaagacataattgaacggaaggcaacggttcaaacgttaagcacgtgtgatgtatgttcatgccacaggaattaaacgacggcgaggggaaattgaatgaacgcatacttgagcccctcattccgtacgtgctcaatcgtcttgcggcggatgtcgaaaaaatggaatatgaacccgtcggtggcaccacttgcgccgctcatgcatataggccaaaggaaatcggaagtagtatttccgatctttcatcattcttccctctagttttcgtcgtcgcattgtttagttctagtttgaacaatttcacctgcgcttacccctcgatactagctttactaacctaaaccttttctccttccattacagctcctcgcagtgcatcatcctgtccgggcccgaacaatctaccgccgcttaaattccactacgtacacggcgacaacattcggatctcacgtgatgcctccgtagcgcggcggtacgaatccttctgcaaaggaatcacattcagcgcccggccggtacgggtcaacgagcgagtctgcgtcaaattcctcgacatctccaacaactggagtggagtcatccggttcggattcacttgcaatgacccggccacgttacgtggcaatctgccaaaatatgcatgcccagatcttaccaacaaacccggattctgggccaaagctttgaatgagctatactgttatcgtaacaacgtactgttctactacgtcacagcctccggagatgtccactttggcatcaacggagaagagaagggagtattcatcaccgacgtcgactcccgtggcccattgtgggccgtcatcgatgtctatggcaattctacagcaattgagttcctagattcgcgaatttacatgttccaacaacagcaacaccaccagcatcatcatcataatcataatcagcagcaaccagcaccaagccagtcctgcggtcgtcgttcggccgatcaagaaattgtacctcagttggaatctcttagcatcaatcaacacaaccagcagctgctggaagaacgtccagttcctacgacggcagttgtcagttcagctgctagcatgcgctataatagcccagctcctggactactacctctcccattccatccaatccgaggacgtaacatcaaattctcccccgaccgtacgatagctacccgtgctgaaaccgaattctgccaaggatacgtattcgcgccccatccaatcaagatcggtgagcggctcatcattcaaattcttaaaacagacaccatgtttgtgggatctctggctcttggactgacgtcgtgtgatccagctaccttacagctctccgatctgccagatgactcggatctactattggaccgtccggaatactgggtcgttagcaaagatgtcgcttccacgctggtccgtggcgacgaactttgcttttccatctcagtgaaaggagaagtgaccatcagtaagaacggcggagctccatctgtgatcatgcacatcgatcagagcctacagatgtgggctttcctggacgtctacggatctacccaaagcgtccgtctattccgtcacgcaattcccactcccgttgcgaccgcttcctgttcggcactgtacccagaacaccgatccatgaccgcttcggcaagccaacgtagcctacaggttcaacccacaagccaacaagcccatccaaccacgacggccaccattcggcccgatatgatacaaatcaatcctggtggtacggttctggtggtgaaccttcccccaacggatgtcatatcccctgcttcctcgcaaccttcggtacagcaagcccaggccaccatcgtgtcccgtggtttaccgagctccgcttcaacgctctcggtgccgctttctactctatcgctttcctcgcattccggttcgaccggaacgggcgatcatgttccggcttacagttacgcagaggtaagaatctgttcttatattttgttggactattagtctgaggctttcctaagttcttaatcaaaatattttgccacaaaactaatcacatttttttcgtttccgcttatcttgcagccaatgccgtcctacaacaatgcatcaaactataacactcttgcggcggcggcggccgccacagcagccagcaccagttccctctctgggccaagcagttcctgttcctccacgccactacccaccccctcgatgggggtaaatcctccgatctacagctcgaccggcgtcgactgtaccatctgcttcgagaaaccgatcgattccgttctgtacatgtgcggtcacatgtgcatgtgctacgactgtgcaatcaagcagtggcgcggaatcggcggtggacactgtccgctgtgtcgggccgtcattcgagacgtgattcgcacctacaaatcctaaatcgttaaggaaaaccccgctgcgggacggtggcgttagccggcacctctctcaatcagtcagtcacgataccaaaaacatgcacgatccattcaaactaaatgacggtaaggaaaggacggctacaattgtgaatgtgattttaaacctaaaaaaacacttaaggaaatgaatgaaacgaagaagcgtaactcggaaagcgaacacacacattgtggacatttggaaacattctggtcaaaattaaagcacttatattttatgcgcgagtaaattattaagttgtcaaaatttctctcaccggttccggtgggagcagagaagccaaggcattatgcgggaagggaattgttggcctacattgggccatgtttagtttcgttttctgtcgaaatcgttgacgaatgcattatctagtgtgtaaggtattttctttgtttttcgtaggaaagaaaataaataactaatcaaaccaaaaatctcaaatttgcatagtcgttactagagcaagaaacaaaatctaaattttattagaaggtcagtaaataattgccaaaaacgtacatcacttcaaaactgcaatcgtaaataacaaaagaa

SEQ ID NO: 157 - DNA, 1837 bp, Aedes aegypti
ccagtgcacaccgaagtaattatttgtaccgtcatccatgtggctcctttttcttctatcgaacgaacgagtccaatttgcattatcaagagattcccaagtaacgatgcgttgcgttgtagtttttagatgagaacttgttccccgtctacttcgaaaatcgaagaaattgcttgtgcagcattctttcaattcacgacctgctggaaagacaatttaatcagaaaaaaaagtttacgccttaaactcacctgcaaactgccgacccgtttcacaaaatggttgatcctctctgatttggttgttgttgttcatgagttcatcgtctatctcatctatatactggttatgtgtgaaactacatagattttggctatgtggtttcacacatatttttgattcacaataatgaacttcagttttgtcacacattcgaatgcacaatattttttgtagcgtaatcatgctctcaagatagaaaaacatttttgtcccagtgtagaaataacatcgaaacgcaaactcgcaaagtgtaccgaaatcccactgcgcactgtcaaaaacgcgtctaaccacatccgcaacagagcggctgtcaaactctcttttctgttccacatcttgtgtgaggacgtagtgtgaaatactcgcccaagtttttggattttttcgggtcgaattcccaattgtacaaccatggccgacacgaccgaagctgagggagtcaagaagaagcgcgcgttccgcaaattcacctaccgcggggtggatctggaccagctcctggacatgaagcaggatctgctgatggagttgatgcacagccgtgccaaacgacgcttgaaccgtggaactcgcaggaagcccgtggccctcatcaagaagctgcgcaaggccaagaagaacgccccaccgaacgagaagccggccatcgtcaagacccatctgcggaacatgattatcgtaccggagatggtcggatccattgttggtatctacaacggcaagacgttcaaccaggtcgaaatcaagccggaaatgatcggccactatctgggagagttctcgctgacctacaagccggtcaagcacggaaggcccggtattggtgccacccacagctcccgtttcatcccgctgaagtagagagtggactggtgttattattcttataatttctcttgtaagtagaccgaagagcaggtgaggaaaatacaaaaaggattgtaaacaaacactgttggaagttggaactgtttctggaatgaagaaaagaacgcctccggaatgtgagaaataggtttatttcatcggtttaaatgaagggacactcgtttgtttacaaatagtgatgctaatgttttacgttttaggaatcgtatctccgcccagggcaattcgggttcaagggatgtgtatgaccgtttcattagcagcagcagaatcgacagcatacgtgtgattcggatttcgcttccttgagcaagattgttcgttttgaacaaaaacggtatctagagcagggctggtagcgagtcactttctaattacttggtcactattttcgaactgaacgcaatgaaaggtcactcaagttttttggatttttcattagtcccatacatagggggacacggggcagtatagacactctaaggaattttcctattttgactgtaaatatatgaatattatactgtttttcatgtgcagtatgcttttcagagttcttaagcatttgttaaacattgttgcaaaattttgataaaaatattacatttctaaaaaaaggtttcaataaagcttatatttggtgtagtcatcatcaagctagcgg

SEQ ID NO: 158 - DNA, 7231 bp, Aedes aegypti
tgctctaacatatttaaactttaatttaaaaattggatccataaatgaaccatgacacttgagatcatgtttgacgttcgcttagtcgacaaaaacaccacaggggttttagtttcaacactggggttgttcctatctgacatttcttaagggacacggaaatcaaaatacacccaaaatttgagtttaagcctaggggcgtagcaaaatctaaaaaaaatgttttttcgactcgaaccaacggaaaacattagaaaattgagtaaacatgtgtttttggcctaaacttaagcctttggcactaaaatcggaacagggctttaggaccctattattaccgagatatcagctgttgggttctcggcgaaaccgtttaagtgtgtagtaacgatcactattttacataataccttattatagtagccgttaccattttgcggtaaaagaaaccatacttggaggtaattgttaccattttactacatagtaaacataagaataactatgtagttggactcactatacattttttatcagtgtataatttcaaacaacctgctaagcacgcagccactaaacaatccaaaaatcgcaccgttcgtaaaatcgacctttcactgtaccgaacgcgcccccatcggacagctgtcagtaaacgcaaactcgctcgaacttccgcccaactgtctgtggtcggctgttctgtcaaaatttgctcctttctcgctctttttccgggcatctttgatgtgcgagtgaacacatttcactgtgaacgtaaaataaattcgctgtaagtggtgtttttctagtggaaattgtgccaaaatgtggggaaaagattcggaaaccggcacaggatggaatgacggtggaatttcggatagttatcgagaaaattgcgtccaaatagaggccagagttggcaccgcgaaatccactgatgattgacacgaaggaaagatgtgttgacaaccgcttgattcataacctgatggaagatttgtgtacagtggaacggattttggataaccggaaggattccagctaacaaaacattctagtggccgttcccttccgaatctttatccttaagtggaggcgaaacttgaagattttgttgtaagaaagtgttccacgattgtttacgttggtgtctctattgcagatggttttcggatcaaaggtgatcaaggccggtggcgccgagcctgatgctttcgagggacaaatcggccaggctatcctggagttggagatgaactcggacctgaagccacagctgcgtgatctgtacatcacccgcgctcgtgagatcgagttcaacagcaagaaggtaaacaatttgttccgtgtacgaaatttaaacatagtttcgtaaaatactgttctatggtaaactatttttagctgggagatagtttattgaacctctgtattataattttaggctatcgtgatctacgtcccggtgcccaagcagaaggccttccagaaggtccaaacccggctggtccgtgagctggagaagaagttctccggcaagcacgtcgtgttcatcggcgagcgtcgcatcctgcccaagccccagcgcggccgccgtgaccccaacaagcagaagcgtccacgatcccgcactctgaccgccgtctacgatgccatcctggaggatctggtcttcccggctgaagtcgtcggcaagcgtatgcgcgtcaagctggacggatcgcagctgatcaaggtgcacctggacaagaaccagcagaccaccattgaacacaaggtaagttcgcacaccattccgctattatctgtctcctgttgagcatcacctacattcggagtgattcgtcacaactaggaatcatttcgtctatacgatgcttagatcaaaagccagtattcctccacccgttgctttactgtatttgcaaaagtctagcggctgaaagagggatgcacatcttttcgattctataacatttctccaaagaccatttcccggaaatccattttctagaacagtcctgaccaaccttctctaatcgttcttagaatactcataaaatttcctgattttacgagaatccagtgcaggattctattgaaaattattcttaggattccgtcaggaacccacccaatactcattttacccctttgcttcccaaagctttgttcgatcatacaatagtcaaaaaaggtttaaacaaattgcttgaacaaaagttcatggtgtctactacctggaaaaacctggaaaacctggaatcatcagggaattttattcaacctggaaaaacctggaattctcagggaattttggatacactcagggaaattatttagaaacattaatagatggtagaatatgtcggttttgtgacacaaaatctcatcaatcaaaaaattttcggctgtgccgctatcaaaacgctatttgacatgttcagtcctttcaacgatttttaattaatcagcataacacatgtttcgaccaggaatcttaagattgccaaattggtgaaggcaagtacagctccaattaggagtcatgagcagttgataagttaaaaacaatcaaaaaatttaacaaaattgttatacaaaaataataaacattgtaggaaatgagcaaacatgacaacaggcacgaaacagttatttctcaagtaagtaaattttcttttgaggtgaagataaatcgaagccaaacctcaaattttcaagagcacgaatctggagaaccgaacatccgtttaagctgaaaacttaatcgattggtcacgagctggtaatgaccaatcgattaagttttcagctcaaacgggtattcggttctccagattcgtgctcttgaaaatttgaagtttggcttcgatttatcttcaccttaaagtttatcgatttatcttaaccttaaagtcttgatgcaaatcttcatttttggttatggtccttaaagtctgtatttcaataaaaattatctttaaagtcactttttaattttcttgcagtgatttctgatgcaaaattctaaaggatccaaagaaacctacaaaaactataaggcaacttgtccacaagttttttatgatatttttattaaaactcgcgaataatgtttcagtaattctagtcatttctttagtggtttcttgttgaatactttcagaaatgactccagagatactaccagcgatttttcaatggctgcttagactaatttcttctaatcgggtccaaaaattctagagcactccaacgcctccacaaatgtttattacagagtttttgaaaaaaaaatcgtttcgacatttttccacaaaatcctacaataattcctaagccgattgtgtccaggcattttgataaggtttttttttcaaatattcatccactattgctttcaggaattgatccaaaaatccgtcaggcattaatcgatgatatatattataaactttcctcgagaaacctcgagcatatcatcgaaatattgttgctgcgattcaaacatttctctaataattttcaaataaaattacccaatctccttggattcttcaaaactttagttcggtctgaatttctccaagtaatttcttaaaatcgttttataggacattatttaaagattcttgttaatttttaaaatattttaggaaaatattatcaaagaggatctcgtaagaattcatcaagacgtacttagaactcacacaagactcatctgaggtcactctaggattttctttcgaaattaaactcatttttttaattttctccataacaatctaaaaaataacttaatacttcgctggatgaaagaatatttaaagactattttgagaaaccaaaaaaaaaatggtattcctgaatgaattttgaactcttgtgaagatgctctaaagggaaattaatggaataacttttggatggatgattcccgatgtgattattcctaaaatatccagattgaattattgaaggtatattaaacgaaattcatggaagaattacttagaaatctcaagacaaactccggaagagatctgcggagtaatatgtgaagaaatctatagtaaatcgagctgttatacttgtcgtaatgtcatgatgaactccgaaaaaggccttagaattattttaagaaaaatgtctgttcaacttaggaatcaaacgctcatgtcgtgcttcctcttcagtttttttttgtcaaggcagaggtctacaaagttttcatttctaatatggtcatactaccaaagaaaatatacgaaaaatgctctccagaaatcctgaatcccattttaagggaaaggatattttttcttaagatcgaatagactattttttcatatctgactttgatgatttaaggcactttcagatcatttgataaactttcttgattttcgtggcaatttaataaaaatcaccattttttttcctatgtttacactatgaacacaacagataattgttttttattgaagtgaaaaaaaactttgaaatttattgtaagatacatttattttcaaagattcctttcatttgaaaaaagttttagtcatttaaaattgactatttttatattttgagggatttctttaacctggaattattttttaaaacctggaaatctcagggaatttcatttctgtaaatgagtagacaccctgaagttgttgcaaataagttaaattattcaaattatctgtacgaaattttgcttcaaaatcaatgattagttgtttttttttctcaataatttgacaattatattgatgtttgatgagactaatgcgcatatacatttattccaatcattattaagttaagcgttctgcaatcccaagtaagacgattcgttttttcgtggcgccggtgaagcccccgcttcgagttgtgcgagtgcgaaaagatattcgtgttcagtcgaggatggatcaccaactgatgagctcgtttcatgcttatggtaacacgcttctatcgtggcaatgtcacgtttatgtaattttaaaacaaactatggataattcgtcactacaattgacaatgttaatactcacatagggtacagattcactttggcatgggaggtttttattggccgactcgtctgaaacattgcaataataagcacttcaatacgacgcatattgtggccaaatatgaactcagtagcttaaaaaaacacttccgaagtgaatcaaaaggggtccgactccctacctctttttttcgtcattactttgtatagttcgcattatggatgtcgacgcactgtttaatctcctacaaatatttaacaactaacgacaaactaaacattacatattgcaatggataaatcgaaataaaattcgcaaaaaatttacacgtcttcacggtgagagtcgatctaccgacttcctgtttagttttacggtagttgttaaaacttttattaagctggttatctgttagcgataaatcatagttaaaaagtatttctacaaatatgttttcaccacgagacaaaaatgtatgactagttttgagtaagagtcgtagttttcctccttatccttggattaatgcaccatgactctcagggaactgattgcagatttcccccttgtaataaatgggtcgtatcaccgaccaaagggtgatccctaatagacacccctcccgtggtgattgcgaagatgcagaggtattctcggtctctggaaacaaaaatcattacacagtaacattccttccctacctcaactgtcaataatcaataatcaaggcctgctaaaatatgtacttcgagactaaccggaaaatgccatcccttattcatttggattgtggggccaaatgtggaagttggccttccttatccgagtggttagagtccgcggctactaagcaaaaccatactgaaggtgtatgggttcgatttccggtcgaaccaggatcttttcgtgtaggaaattttcttggcttccctgggcatggagtatcatggtatctgccacacaatatacggatgcggaaatggcaacttcgacaaaaaaagctctcagttaataactgtggaagtgctcattaaacactaagctgagtaaaaggctctgtcctagtgcgaacgtaatgtcaagaacaagaagaaatgtaattcttaccagttccgatcaatcacggagtatcaaccattgacatgtgcagtcagtctatgctatgctttgtaatggttctcaggggaatgttatagaatccttcttttcaacaatcatcgattcagtttcaatcgtaaacatcattctaatcgaaatttttcgctctttctctccatccaggtcgacaccttcacgtcagtgtacaagaagctgaccggacgtgacgttacgttcgaattcccggagccctacctataaactattacaaccaatagttgctagaaattaatctaataagtgagcgcgcgcggaaggttggtaaaactgaagaaaaaaaactatgtacggaactagggtgtgcataaatcatctttgtgctgcatcgttcgccccctttaaataaagaccctcaccaaacggagggacaagaacagtttacaggtgtattggaaaacaatttctaacagttgaacagagtttggactggtgtgcagatagagaaatgccttttttttgccgtaatgaagattgtggtgtcctctgcgtggtttatggacaaaaggtcgaagggacaaaaggttgaaaacgatttgcatggtgcaggatgtccatccatccgggaaaagcgggaaaaacacgggaattacaactgtccgggaaattgcagaacactccgggaaagacactagaaattttttccaaaggatgcatgactagacacggtttctagtacatttatagccaaaaaattgttagtttcaaggagatatctttgacaggtttttttttcacaattgtaaccgatttcttgtagaatgctttgcaaatttctgacagtgcatcgttgagatccttgaaaagtgtttgagtatttaggtatttctggcaaggttcttgatcagatgctttataaattactattgagattcatggcacatttttgatgacatcttttcgggaattctaaatggattcgaggcgataattgaaaattaactttggaaaatcactgcaaagactgcactgattgcaaatgagatttttagtggattttaaaaaagagttttggt

SEQ ID NO: 159 - DNA, 37555 bp, Aedes aegypti
  misc_feature (22965)..(23064): n is a, c, g, or t
taaaagggcctatctgccgatgatgtttgaattcaacattttttactagtttctatgttatgttagatttaaaacgttacgtggctcagtaatagactatgagtgtcgaacaaaagtttaaaactattagatagcaatgagtttaaaatagtaacaatcaatatgttacagaatcttcaatcgagcatttctcaatttttacgttatgctgatcactatacaagggctaaatattgacaaatatggaggaaaattagaaatgcacggaagggccaatctgattttgatggaaattttcagttaggcccttttatgaccagttaggccctcttagttttatcattttcagataggcccttttaaatttgaataaaatttccattaataatgcattttgcatgcccgtatgagtatgtagaagtaatttacgtaaaaaatgatacgaataatgaataatcaagtttgtttacattttgcagttaggcccttttcaaatgttacgctagaactctcctccgcgccgcctcctcttcctcaatcaccttgcacaactctttccccttatccatcttgcacaccccgaccgaaacccgaagcgacagtcgttgtgtggaaaacgcatagacaccatcagtgctttttactttttcacgtcgtagaaggaaatcgtaagtccgaatcctaatctcaagctataatttctccgttttgtccaattttgtgttgcttaaacgcttctcgaacgtaagtatgttttagttcttttcatttagtttgtgaattagatggaggtttattcgattgttctataatgtgacatgaaatgcaatttttttttctttcactgcatgaagtcgacgtggtttctttcccttctcatattttcatcatgtcgacgaccgcttgcgtaagcctcgttaatcccatatgcaggagtcaccacaatgcccacctagtccaaagttctgtgattaatcagtaaatgtgtctaggttgttaaattaataggaattttgccataaaattgattaaattgcacgcttttatcaccaccataattggttagcaacccatgcagttaggcgttcgccatatttcctaagatttagttagggtgttcctcaaagtttcttatcaccaaggctacagaatgtgtttacggtttaggtttacatagtaatttgtagtgactttgattcagtatttacattgttcgtacataaacagttcttacaagtgttggataagttcatgagacgaacacattttttttagtagtcttatgctcattatgaaagttcaaaaaattcaacgttctcttatgtcagccgaaaattgagtggttttcttttaaagctgttgtaatgttttgttaaaagtatttattatgttttcggtagggctggctcgtttttagaaacttggtcccaattttatggcttaagaatcaatcatttaatcataaaaaacacaaacctgtattttctttcaaatttatagaaaacttcatgaaacagaaaacaagaaaattgatatgactaacacgagggggccaacattgttgcaattttttcaactcgtgattaataagttatttcaaacaccaagtttgtttgaaattgctattcgataatgtacagtgatacctccatgactcgatatcgactcatggaaccatactaaaaacagaatttcatggttactatgatggtccctagaaaccactttccaaaggattgctgttccatgagtcgatggtcccttcaatatcgactcatggaggtttcactgtagtaacgtttaccagcatgaaggaaatttacgaaaattgcaaaacaatgcctagaacatcgctacgaacgcgaatagcgattattatcgtattctgttgaagttcgttgtgataaactgttgctgcggaataagattgttgcaactagaatggataaggacaatgtatttgttgctgtgttggttgacaattgattgactgatttcgcaaaaaatggttttaaaaatttgtaaacgttgatgattatattttatattactctctagttttaacacaaggtctctaaagtctcaactgtaaccaaaatggtctctaaagtcacttttcttctctccatattctgcttacactgaatcgtcttgtcaaattttagaagtaacggaaaaactttcagattgcacaagttctccaggaatttcttctcagtttccccgaggaagagcttcaggaattctgctattgatttctttagagatttcttatggcatacttccaaagacttcttcagagatttttccagcggtgtttccagggatgcttagaaaaatttctttaaaatttgctccataaaatccttgagcactcccaacgtttatatctttagtagtttcccagagacgcatctcaggcagggctgttaagaatcatgacccgcttgcgacactgacgtaaccagtcttctcactgtcattaggcgaaactatatttcatgtgctcactccgtcagatcgcaatgacggggctctcatgagagcaattttaaagttgttttgctttaaaaaattctatctcattttggaaaatttcgggaagcaaatgtgtttgataagtaaagtggatatattttcacgattctagtgatataaataacaatcatatctgataatgaaataaaaatggtcaagtttacaattccgtcacaagccgtagcgacagaaaaatgaaggagcgtttgaagaaagcttctgtcattgtctcgccgtccgatgacagtgagagaagcatctatgtaaaagtcgcgcgacaccctctattaacattgacgctttccagcactgatctcaggacgcctttcaggtattttacactagttcttccactgatttccttagttatgatattataggaaatattccaaagattcctacaggagttcttccaataaaatccacaaaggttcatatcaaagttttttgaagaaattcgtttaggaaattttcaggaaaatcaagagtttctttagaactgaatcaactttcattagatattatttttttacaactatctctcgaataaaaataaaatcttgatttttttctcgaaaaatgactaacaactcgactcgacttacacaatgagtttagaggtacttgcaggagtacagcccgtgcgatctcataccgacaacggcagcatcacccagccaagcgcaaattgaatcattcaatttgttgcccattgtttggttcttttgcttcaacgcgtcgtcagcccaacgctgtgatatgcaccatccagcgtagcagtgcgcacgattcctttcatttccacttatctatctccgtactgtgtcgcctatataagtcgacagaattttgtatatgtaatatagtttctctcgttccccattgttgctgtgagccaattgatgactggatctcttgcgatgaaagtggattggattgatgaacataacgccgggtatgtactgagctggcccgtgggagatttctgctttattggatgacagcttggtctgactgtgccgagttgaaggccgaaattcccggttgccagtggatactgccgttggtcgaatcgggatgaagcaatagcttcggtagtttcacaacgccggtgaaaggggtgaccgtttgattcgaccaatagaatggatgaaacgtctgttgaaatcatggtttggtattttgggagttgaccagtgggagattcctgcttgacggacgacaagcgtgatctgactacgccgagtggaaggtcggaattccagagcgccaacgaatactaccgatgatcgtgtcggaaatgaagcgcccagcttcagaagatccacacggaggtgaatgggattttgccgattgacacgattgtttggaaggatggatgggccgccggacatgatggcacatagtccgaatgtgaacacgctggttcggagggtcgatgataggctgccggtttggaacttagatagtggatacgccgatccggaaggatgattagcttgaccagatttagacacgccggttcggaaggaagatggacttgttcggtggacacaacggtccggaaagaggtttcactgtttcactgatggactcgccggtccggtaggaggatgaacggttacgttgtcttcgatcgccgtcgggatttcacttgcactttcgcttcaagatcgctggcggtgcgatcaatcctgggtttggtcagtccgtggtcgctccttggcggccaatcctgattttggtcggttcattcgcggcccattccttccccggtgaaacacagcccctgatagaccgtttcgcggagttaacactcaggttcctcatccgttgtgaagttctccatccattgtttattgaaaacttcgaaaagctgcttgaacataatcctcaaacttgtttcatgagcgtgtactactggtacatttacgttcaaagtttatccctcgcatgtttgcaagtaaattcgggcatgtcagcgaggaccgacagttcttcaattatgggtcaaaaatggatgatatcaatggtttcggtgtttacaacgtttctcatagcgcctccttcatgcttcaaaaaccatgttctgtatatgttgctgagctagcagctatacattacaccttacagtacatcagttctctcccatccgagcacttcttcatttttccgacactctaagttctctggaggctgttcggtcaatgaagccgatgaagcacgcggcgtacttcctgactggaaacgccaagcattgaatgctttgtcaagtcgctcttacactattaccatgggatgagttccttcccattgcttcagtccgggcaatgagaaagcggactctggtaacggtaggcgctgaagaaggcgatgtttacgagtttacgagtgacgacaaaatggatatatggctgcattccatatttccacaggtgtcgaaaaaacatggtttaaggggttgggctctgagaaagcaatttctgtgtttgcggcgtagcttaccagaatatcgaacacgtctaatggggatgcggtgagcatcgtggcatcagatctgaactgactaaaactctccagatccgaggaaagcagcagacacctgttgaaagtgttgacgggccttgatttggaatatatgaatctgatttacctgttttaaaacgtatcaatatccgagattgtcggtcgctccatggttttgttttccccttcaaattgtcatcttctagtcgtgtctcccacaatccgtttttgtttagtttcgttacatatcaggacatcctgtcccatcaaacttcatcagcttagtagtctaagtagctcaattatcattataagatttgaaatcccgaaaaatcctttcctttcctgttgtatacgtatattctgtaatctcggagcttccccaaacttacattgtttttaaataaatataaatagaaaattgcaaataatgtaaaaaaagaaaagattttggctgtaataccctacggcgcccgagcctgccaaataaacgagataagtaaaaaaataatatttcaaggcttccttggcaagtttctcaaagagttcctgaaggtaatcctgagtaatactagttgaatgctaagaaaatattcttagcgagaatgtaggagatgaggttcctagaggactgaagactttcttgaaaaaaaaacttatagaatcttaaacgtattcttaaataaatacctgttcccgttagtttttttcttcacaaatttgttttccttttttaggtaaaatgtttttaaagctacagggcccagatagccgtagcgataaacgcacagcaagacatgcggcatgcaagtcacattcggctctcagttaacaagtgctcataagaagcaggctctgtcccagttgggacataacgccagaaagaagaagaagtctttaaattttaaagtctattttttgaatacaaatagcctgcaaatttcggaagagtctttatcattaattgaaggtgtctaaagtcatttttttaattacttctacaaaaaattgtcaaaaatgctactccagtaggtgaattccggcgaacaatttcttcgaggagaagaagctttcttgcattacttttcttcgaaaaaaatacgcgccgaaattcgcctacaggatttcttcctgaggcgttttttacaaattccagtttttcaccgtttttctagcagttgagtgaagaactagccaaatgtgttaaaattcacgttaataaggccggaacaaatcttaaaatcttcttttgtcacctttcatcaaaatgtgtcgaggggggggacaataaataataaaatggaaattcaggtgaatttttcataacaacaatctcaggtttttgctgtcttttttgttgaaatttgacgagagaaaatattaaacttttaaattgtgtttaagctaatcacaattttaagaacattgcagaaatgctgcacttggatgcaactttaaattaaatttagattatactaattcgatttcatatatatgtaacaatttgtttgaaattttcctctagatttgaataaatttgaagaaaattggttttgtgaattatattgccttcgatgttctcttgtgccatgttctttgcataccttagcaactgtgagataaatatgcataggatggcatatattatacaattgaaagtagggacaatggaaattcacagtaaaattcttaaaatttcacgggtgacgaagttgatgaaactaaaatttctcggtttagtcgtggccccatacttttggtcaaattttgctctgtagtatgtattctcagtgaaaatacattttatatgtgtaaactcagcgatgtgttgataattgtaatttgtattttacggatcaagattattaagtttattaccagagtggcaatttaaaatttaaaacaaaacaagcaatcaaaagaagtcaaagattaactgaaagatacgaaaattgttggatgaaccttgactccaaaataaatgaaccattttcatcggcaagaaactgaaaactactgcgtttttatatgaattaaaaggatccaacgcatttcgcgggttttcttgaatttcgaaaaaaaagaatcataaagattataccaacacaataaagacaaggacatttgatacgcagcttgtggatgatgatcacgctttcaatatttatacatccagaggaaggaaaatttactaggaaaacatgtattcaaataaattttaagagccaattgctgaattgatttgacaaattggttactgcactacaatattctattttcaaaggctacactgttacaacaaaattgcgcaaactggattttaaaagaaaaaacgtttaaaaaaaccaacgaacagatttaggacttaaagtccaataacacctgttatttcatgtaatatcgtaagaacgaatcacaaaactagctaaaaacacaaaaacaatgaaaaccaacaatgaaaataagaaactttatttatttcccccctctgaatttttgaaaaatttgaaggggggggggggtgacaaaagtaaaatttcaaatttgttccggcctaaaggcaaaaaaagattttcaaggtgttgccctagcagatcttatagaaagttctacatgatttcttccaagaacttccaggaattcctcattaaatttgttctatgatttatattaatttcatccagaaatttatctagaaatttctccaatatctcatccacaaattacccctgcagatcataaaatttccatggatccttctatatttcatttggggtttcaaactagctgaactacagtaatatcaacactaagttcttcaaacatcctattcaatgtattttatggaatgtctacataaaattctacagcttttcagggattcaattgattatttttgcaatagtaatctcagctattcatctagaaatatctccgacttcgtcagaagtttggagagttttcagagatccagccaagagttcatcagggatttcctcagaagtttcaacagaaatcactataggtttagttttagcgctaaaatgcccgttcgatttaggcgacatgccaaaacatttcatgttgtctaaatcgaacagtgatgtttgtattaacacttttaccaccgtaataatgaccaccaatttgatttaccttttactgaacatggtgagcctcaaaaaggcccacagaagaattgaaattaacaggattggtgactgaccatgatccatttttctttatgtatttttgtgttgtcaaaatcgaatgggtactgtattctctggattttgttaggaatttcttagagatttcagaggcataatcctagcaaaatcgattgaataatcatagaacgtttggactccaggattttttgataaatttttgaaagaatttggaggaattcctgaaaacgtttatagtgaagtctctgaagtttcccttaaagtaccaatgaatgaattgcggatacctgaatttgtgtctggtgtttgatgaaattcctaaaaagaatcttacagtgtgcgagcaatagtacttgtaaataaaaaaatctgtcctgattttccttaaaaaatcttataaacattttaatattttgattcctgttatgactaaaacaacaattttttagattgctggatggtctctgtttggttcccattcggtcttattttgctcttttttacaacaatacaacagttatgagagaaaccactaaattttcaacatctatgcaaaaataatgttgtgccaatttttaggctgactagaggaaaaagtaaaggaaatgatttccgcttgagcagtaatcaagagcggagacaaacattcagtgttttataaaaaaatcattaaattatcacttgttggttataaattaaacttagccttagaaaacgtaattcaatgcatttcatactgctctgcacattgatttattttaagtgcttatgtttaacattcaccctatccataatcgttatcaagatgaaggcgtaccactaatccgtttttccccattgtgttcttttccttttcagaatctcgtctgaaacggtgttttatctcccatatcaatcagtgagagcaaataatcggaagcaaaagagagccacactcggtcgaagtttaatcttcctaattcttaatagtgcagtaattagtcgtcggtttagtttgtgaattgattggaggaaaggatcgcctcgagtggcgctagcgttttatatgactttagaaagaatccaaggtaagttgacgaaattcgttcattctatttgcttaaaccgaaactgaaagaaaactattagtccgcaatggtcacatagtttggatgtgttaaaattattaatagccaccgtgtcgacaccttttcttgcttaccggctcgtaaagccagctcagcaacagcgccgagctttaattttagaacctagatgtgataaaaaatgcactggtgtgtttacattactgcgagcgtgtttgaaaaaaaaacagagcagaaaaagtgcatgccacgtctcgtctagttgcaaaccttggtgattcgagaagttttgttttcagtggttcagtagcgcaaccaggatttggctctagggggggttttgtaaacttgaagataatgtgtttttgggaaaataaaacgagtgtaaaaaaattcgatgataaaaattgagcaatattgcttgattaacattaaacaaaaaactcaacgccatatgcaaagtaaggctattatcttccaccctgagcatttttgtatagagttacaaagctactcaaaggaaatttgttgtatctggtgaaaatttccaaaagtttcttcgggtttcaaaaaacatttcgttctttacaaacattgtcttagattaaactttttaaatatggattacaaaacgggattattataatatcatttagatcttaatttttcgtagtttgttctaaagtttatccatgttacatttggaggcacattggcttggatacgttcaatcactctacgtctgatctgttccttacatacgttttcaagtttttcaacgagcatgatgatctttcagcgcaagtcgcagtaataagtattgcgactatcattagcagtttgccgaaggcaaaacagcattgcagatattgaagcatttcaagattgtagacgaaactgtgttattttccagcttaccaacaatcacgatctcccttaatctttcctaggatttttgtttgttatcattgaaaactaatgaattgcttctccggaaattcacgtgctatctggaggttataaaattcggcaaaatgctgagccagctaacaaatttttcgaaaaatcgaattttgatgaaaaatgcattattaaagcggtctcaatatgtttgtttcacaaacttctcttcaaaaacctgtagcttatttataagaaaaagcgagaaaatttagtgctcctcaatagtcttcaaattagaaagctacaacatagaacaatataattgttaacacaacttactgctccgatgtttgtggattttagtgttgaatttcaaaaatatatttgataattcctatggaaaaaatctgctctgggggggggggtttgacccccaaaacccccccttcgccactgcagtggtttgttatttaaatttgaccaaaagttttcgcttcgtgtggaacactctgatgtatactggaaacattccctatataggtactatctaagaagtgacaatggaaatacgagggatacatcaagtggactcaaagatgtttttcataactataacataacataacatactattctagtgaaacataaattcaagaccaatacgttcatcttgatactgcgtgatatgaagctaaactttattcgacacaatttaagttgaaatacttttaaacctagtataggggaaataggggcgtaatgaacacacgaggcgaaatggacacctccttatctgaaaccttatgaaacctgtattgtatgtgaactgtttgacgatatgtataaaatatgtttaaacttgtcgttttcaaaacggccagtcactatcagccctgatttcacaaagatatctatgaaaaaatacagaacgtcttcctgtgaaattctttaggtaccttgctgatgtccataaaccagattcccatttcaagagaaaggctttttttcttaaattcgaatagactattttcttcatatctgactttgatgattaaaggagcatttgaaaatcattcttggttttcgtggaaataattatttttttcttaagtttaacaaatatttttatttcatttaagtgaaaaatactttgaaatttattgttagttttttttttgtttaattgttttgatgccgagctcctaattttgaaaataaatttttagtcatctaaaatgaaaaaaatgtcaaacatttatatattttggagaatttcttgaacctggaattattttcgaaacctgagaaaacctggtaatatcagggaatttcatttctgtaaatgagtagatttatgatttttgaacgattgcagcacgtcatacttcctacaaagctggaaattagcagagggtataaatggtcataaaataaaattcagtccgccatacattatgtttcagcatagataaacaaataaataacattttaaacaatttcctttagaatgtatcgtgctttttgatctggtgaccatgttgcacaacatacgattatgtgcagtaatgcctgaagaaggtgctagtgtgaagcgtcaaacaggaagaaaaatgaagtgttgtgaagtacagggtgtccatccatccaggaaaagcgggaaaaacccgggaataaaatgaccggaaaaaatacggtaaatatccgggaattaggagaatataccgggaaaccaatccctgagggatttcttgaaggatttaaggaggatttacggaacgattctcgatgaatttccggttgaatcctaacgaaatttatggacgaatctcaaattccgcaagaatttaggaaaaaattctggaagtatacgaaagagtcaaagaaggatgtccgtaagcatctcagaaagattccagaagaatccttgtagtagaagaatttcaggaggatttccaagagttatcgaaaaataacctgcaaaattccagcaggatttttgggaggatcctaaagagatttacggacaaatcccatagggttgcccggaaaaatcctcgaaaaatattcgaaagaattttaacgggatttcgaaagaattcgagaagatttacgcaagaattgcagaggcatttcagaaaaaatctccgatggttttgtggaagctgcaaagaaggatttcttgaagaatccaagttttttttttcggaagaatcctcgacagaaatcttgaaggtttccagtaagatttttggaggagctccagaggaaaaatcctagaaggatatccagaaggatctcaaaactaattccagaaaagctccattaaaattttcggaagaattccaaaaggattttgcaaaaagtctccaagaaacatccggaactccagaggaaatttcataagaacccctgggctatttccggaaaaccgatttgtttcaatgtcaagcactatgggcgaaactagatttttttccacaaagtgtacgaccaccaatgtttggataaagtgtgcgcaccaatgtttggtgatttggtagacagatagattaagctttttgaaatattaacggtttatgcactgtgatcaaatcctctaaagtgatgtatgctgacgacttcaaattcttccgtgatgtcacctcctgtagattgctgcgcactacaaatggacattgaccgtctgctggactggtgcaaggaaaatgatatggaggtgaacattagaaaaagcaacgtaattacattctcgcgattacaatcaacgttcgcttttgaatacactatgggcgatagcgtgttggagagagttgcatatgttaaagatttaggagttacgatcgatgctaagctcagattctcgcaacatatatcttccgtgacagcaaaggcatttgtagttctgggtataatcagacgcaatactcaagcgtttcgcgatatatactgtctcaaatcattgtatgtatctcttgtacgcagtatattggaatacggcgtcaccgtctgggcaccttaccatgctgttcaaatcgctcgcctagaacgcgtacagaaaactttcctccgatttgcacttcgtcatctcccatggcgtaacaatcaccatctccctccttatgaacagcgttgtgccctcataaagttgcctacactacagaatcgacgggaacttcttcaacgattgctgatattcgacctgctcaacaacaaccttgactgctccgatctcttggaaaggctacgcttcaacgcaccgggaaggtcgacgagaagattcgatttcttcagaagggctacgcatcgcacccagtatgggcagaataaccctctaaatatgtgttgtcaacgttttaatgaagtgtaccacttgtttgattttaatttgtccaaaaatgtgtttagattaagaattagcgcataagctatagtctgtacgatagtgagttttatcgaagatttttacaatctatataaataaaaatggaatggtgtttgtatgtcacgaaatggcatacaaacgggttagcggatttggatgattctttttccattttgttcgttaagggttccgacgtgtttgtgtgtataaaagttccaggacattcaccgggaaagccggaaaaacgacagtgaacggaagtgagtgtcattttgtatgggacgattcgtagcggttttcatcagcctacttgatggcaaaacgaagtttgccgggaccactagtaaataaataaataaataagaagggtatttcgggattctgggcaaggttattggcgaaattcttgttagatgtccatttagattcatagccatgttttatgagatatttgctggaatccttacggatatacggatatcgaaccgataattgatcaatttcttgaaagttcagagattactgaaaaggatatcagcagattgctattatggtttttagtgggtattagaatagacccttggatgatattgcttgaaattcttagtaaaaaactaaacaaaaaattgccaattatttttttgaaatcattctccgtaagcaggatttttgattactattaatgatactgattcttagtgtagccctaggtaaagcctcatctcgattactaattggagtagtccttgatctacaataaaggcttatgagacgcctgaaaagattttgtatagatttcttcatatttacagcgaattcttcttatcatccccgacaaatttcttgaattttttttatgaaatcatgacaagctctttgatggataaataaatagcgaggtcattttgttattcctagccagatttttgattcatgagattcttggaagatgcaattttgaaattatgtcaaaagtgttagccaatttcatacgagatcaaaaaaatgtatttggagatatcgtttctgttaatcgctccttggattcaacatgagttccaccagatcaagaactttttaaagaagcgtcatgtcttacgcgtagtttcgaaggaattgcagaaggaaatagtttgactatagagctttgcccttatgtgaaaatatagtctaaataagaggcgaaccagcatacggctggaagtctctataataaagcaaatcaatcaatcaagaaatatagcctaaatttagataaactgagcagaaatttttcatattattcagaattatctgtgttagatattaaattgaactaccactgtatctgaaatcttacccagactgaaacatttcagcctcgcacttctttctattattcacttatgccattgaaatacagtttagtttagaacagagtactgatcacatgtgcaaagtctccgtggtttatccgaaaatcgtcattttgccagcaattctcccatcccgaagattaccacggccgattggaattctcgttgtcggtttatgtgatagtgccaaaatacgtcgatctgctagattgaagcgatattctcccaaccgtttgcctttccgcgacccattgtcgctgaggttgatgtgaacctgtatcgagcaaacggccgcatcacaccccgtaagaacccgttcccgtcctcgctgtggcccccaaaacatcaaagtcaattaaccacccgtccagtgcccatcaatctgagctgtctatgacttgggtggacggtccttagatatttcaacaaatagtttatatctttttgtccaaaacgtttttgaaatttaaaacgtttgaagcttatggcattttataaatataaataaaaatagttcataaataagtcagttaaagtcctccaaatttgtacgagaaaaaaaaaactaaaatatcatttgccatcagtttgtcaatattttggacccgggaaaattgcgggaatcggaaaattggttttgaatggacactctggaagtatgaaatatgggaaattctaaataacctattgtgcattggggtcacttttggccaatcgatgaatgagctgtaactacgtagagaagatagaagagataaaaatctgaaattttctaacttcctaacgtttgaaaaccgacctctaggagtggcgcttcaaaaaagagacagattcaaaaatgacccatgactttgaaacgctctcaaaaatacatttttgagccgatttttgttaatttaggaaatctttcgaagttttctccaggaattctaccaaaaattccttccaagataatctctaccacgatttcttcagggattttaccagatatttctccaggagttcattctcacatgaatttctccaggaatcatgggaggcaggttccgataggactccagttcatccagggattgctctaaggattattgcagggattaccgcaagaaaatttctacaaggatttctctacagatttcgtgaggattttcttacacctacacattaatgcttccagtggacggctatgtcctttgaaggaagcaccacactagacaacggattagcatgcaacgcccagtggcacaatcggaaaacgttcctgacgaaaagtttttcggactgaagcgggaatcgaacccacactccttgacacgatgcggctaaacgctttgttcctgcaggaatgccgttagtgattccttcatacattcctccagtaaaaagtttactgggatttccaggaattcttccatggatttgtccaaaaattcccctagagattcttccgagaattcagctagcgatttctcgaaatattgtttctgagattgctctagaaattcctcgctatactccaccaaggattcctccggaaatccacaagaattcatgcagagatgtttccaggggttacacaatctgttctgaaataattcctgaaggaattccttcaagagaatactgcagggattcctcctgaaattattcaggagatttcttcagggaatctaccagagattcaacctaatccttagagatagtcttgtttcacatttttcaaactcgaacgcgtcccgtttaattttttccatcccggacccgacccgaactcgaaacaataactgaaaagcaaacccgaacccgaaacatgtgcgctgttcaaacctgaacccgactcaaaaccctaaaaaaatgtctaagaaaaccctgaataaaacccgaattcgaaaagtttctaatgtatagtgaagcttttaggttattactctgttcacaattcttaccaaactagacccaaaccctacttttttctagtccgaatccgacggaaacccgatgacagtgttggtggtctaatggctaccgcttctgattcataaatagaatgttatttgttcaatcccatgcccgtccctttcctcgtactttgtagttgtatctttcacttgcttctatctaccactcttaatatatcacagttgatgtatctatcacagttcatagcatttgctagaacccgagacggacagaaataaaccatttccctacgcttccattcgttcatcattctagcatgccttccttcacgcctgatacataggcagtctgctaaccgaaccagcaagcctctctgccataaaaattaccccaccctttcgcccttcccgcatgaactggcgtttacgcagtggtcaaccgtggaagccagttgaaatgcatcatcaattccttccccttcccctcattggtctgcattctgacgtggcaggcaccattgttgcctaaaaatagatgatcagcagcacttatacactgagggtgcctgttaatcccaagcagtcatttggttggttccttgtgtaagtgcagctgatctggcaatactggagtagcaaccacgggcggccaatcaagctcaagctcaagtccgaacccgtccggtacccgataattttgtacaattcaaacccgacccggtcaagaaaaattttaaattgaaaacccgacacccgatcatctctagtagtccgccagcgattttttctctggtaatcccagaattgttgtggcccacaaaaatgccgttgttttctccaacatttcccttagaaattccttcagagattcttccatgaattccgtaaaaaaattatctgaaattaacctaagaattcctccagggatttctccatgatttcttacagatattcctccaggaactcttttcctgaaatattatttttttaattcctgaataagttcttggaggaatccctgtaggatcctctcggaaaattcattattcctcctgatggatttcatgaagtaatcattagagcaattcttggaagaatcccttgaggaatttctggttaaacatctggagaaactttcaggactccgtggtgggatagccgaggaattcctggaaaatccctggaggaacacatggagatttttgtcgaataatctgttaagaaatttctgaaggaaaccctgtttagattttcgtggaggaatccttggagaagtctcttactgtagctggataaatttctgatagaatcaatgaaggggttaatatgtatattgctgaaggaaactctaaagaattacctgggcaacttgctgaaggaatactggaggtatctctgaagatttttctgatgaaatcccttgattattccttagaggaatccatggagatatttttatagaaattcctctctatgaaggaatctatggagataggaatatcctagagaaatcttttaagagattgtccaaatgtaattccccaagcaatcaaaagttaggataaaagggcatgctttggcttaaccagctcactttttaggtagttaagcgaactttacagtttacataaagtgcatttaagttgcttatacaccttataagtagaagaaaggttcaattcaatcttgtttttaactttctagttgttgatcagttcattagtttctctcttgtgaatcaagttctgttaatatccgtggtgcttactcaatcagcgaaatcactgaaactagaatttgtactagaagtgaactatggagtttactgcttcagcacaatccgaactagtggttacttgggtctggataaaccattggtaaaatatctagagaaattcttgcagagattgtactagtgtaacccctggatgaaaatctggagaaagccttggagacatctctgcaagaatccctttagagattttcctggacaaatccttggaggatttactggaggcataaagaaatatctggaaaaatcgcccaaagaacctctggagggattcgtgaagcaatccctggaaaagttcccggaaaaatcgttggagaaactgctggaggaaacccagtaaacattttactggaggtattcgcgcaggaactctttgcaaaatctgtagagaattccttgtggagactttcctgtatgaatccttggaataattcttggacttggaggaatctcttgtgaaatctcttgagaaatcgttatatggattactgtagagattattttacaggaatttctgaagaaattactggaaaattctctggactttttttggtttgaattcttgtaggaacctctagaggttttactgaaagaattctaccatctacgtgttagtacaaggtcaaagataaataattattgcaatttggtacgataggtaccaagcatttctaagtttaccagtttgcaaattttaaaatgcatttttaatcaaaagaaacaatggagctataatttctgcatcagtctaatgtagaacttatttgatttgagatgctggaatgaagacgtcttaaaatagaccaaaccaatacattgcatatcatttttccaataatcacagtaccgcacaaaagctttaccttcgcggatgtttcgcgtttccaaattttcactccctcgaaatatttgaaattggttccgttggatactctcatgagaaaatgtggagactgcgcagtgatcacgtgttggtgcaatttattgttttggagctcatgtctcgcatggtgactggccaatgattgtttggtgcatgcatggatgaaatttcggaatttaacattctactacgaaaactagccagtataccatcatgtgcatattgagagtatgctaattagtcatgctaaatagttctgatcgctctgatttgtgctatctagcaactgttcgttcgtttaaaattgtgctgacgaactattcgctttttaattgcctgggctccagatacctttttttgaaaagtgccccatcctgtgactaggaagagaatccgggcatccggatcatatggcggaaataccacatcgagattttcctgggagagcgagagagcaaagctgggctcataaagtttctgcttatttcccacatactgcagcagttgaataatatcctatcagcgagacggtgacgtgtttgtccttgtgcgaaaaatttgcagaaatttctgctgcaaatccggtgtgatccagtggaagcttggcaaaattcagcttttactgcttgaaccccatcttccgacaataggaaacatagaattcggcgtgtctagtgcagccacttcatctgtgtatcatatgattgggattttccagccggaatcgaccggccatcacagaggtgagttgtgtttcgatttttcatggactccagggaaatggactgttcatcttttccagtctgaagatgagcattgagcatgtatgtatcattccaaaattttcgttagaagttgatgcgataaaagttatagaagacagacacttagataatttccattttaatgcagctcatactaatcccgttctgaaagcaattactgtctttgatactgtgttatttcctgtggtcgctgttataggtttttgattactgcaacgaccttgaacaacaacacaatggtttacatgaagaatgtgtcgtttaaaacatgtatttgcgtgaaagaagacaaaaatcatggcctattttaatacaactaaagtatagaaatcttaatatttgataaaacatggaaacaattcaaaatttcctttacaaaaaatgctgaatttggatcattagaaaacttataactagaaatctgtaaaaggaggttaacaataataataaggttactcgttcccatagtaaaattgcatcacttagtgaagtttgctttattttgtagcagcattggttcatgatattacagtagaagctggttatagcgactgtcgtatagaaaaatcgttgactagaaaggatttgaaacaataaatatgtgtgtcgtatttcatcttttgcatggaattttaacgaaatatgcaatgttggtgaatatgccctcctttgagactcggactcaaaaatgtgtatatattgctgtttgcttttaacgtgcaaatgcagtctaaataggcttcaaatgcggaaacacaaagtaaccaaaggagcaaccttgatcaatatcaccgccgacccagcctagaaacacaaactttgacttcgccttccttagccgagtggttagagtccgcggctacaaagcaaagccatgctgaaggtgtctgggttcgaatcccggtcggtccaggatcttttcgtaaagaaaatatccttgacttccctgggcatagagtatcatcgtacctgccacacgatatacgaatgcgaaaatggcaactttggcaaagaaagctctcagttaataactgtggaagtgctcacaagaacactacgctgagaagcaggctctgtcccagtgaggacgtaaatgccaagaaggaggaggaggacttggccttccttgttaaaaatcttaccgcgtttggtgttcccgcatttgaaatttgcatttcaaacgcacacagcaatattgatacatctatataaataaaaatggagtggtgtttgtatgtcacgaaatggctcgagaacgggtcaacaaatggtcgcaagtttttcactgttgccctctacaagtggtgcgacgtgttcgtgcgaggaaaaagttcaggaaattctccggaataatcgggaaaacgggagagaactgatgtgtccttctcccatggcgtttgcgtgatcagcatagagtatccagccattatccatcctatcaacggctttggattgacttgcactcttattgccacaccaaacgctgcaaaatgaaaattgatgctcttaactttgtattgactaatttaaccttccgtcagtcgctcaaaaaaaaagttacaccagcgcacaatggtcggaaaaaaacgaagtttggccaaaactaattttatcgccttaatcgatgaaatatgtaatctgaatatgttatttggcgtttttattgtttcagaaggggttattcacatattacgtaacttttttttaagttttttttactaaaaatgctatcaaatttggctgaaagcacaaattttgtttgtatttaaacgagtttgatcaaaatatgtatgaagagtggttaaatatattttatataaactttatatgaaaaatatcgtcaaaatgtatgaaaatattgaattattcaaatagctctaacttgtatatcagcaaatttctgcaaaaaaattaaacgttttttgtaagatctaaggatgtattttaatgtgcaatattcgaaatcgcggcgacatgacgcgacaaaagttgtttttcatgttcaaaatcatcaaaattactaaagtgtaatattgaacagttttaaaacttcaaccacatatttttttccatcctcatgctcgataaaagtgttgaaccataagctttcagatagtgcgtaactttgggaaaatattgcattccttaaatatgaattttgtactttattttattgttgaatttttcatttttttgactacagtcattttgacgttataaaagtcaaagaaatttaaattttaatacaatttcaattaagaatcatgataatataatacatgaggtatattttaaagtgataaaaaccataaaaatctcaaaaaattgttttggtagttttggccgctcctttatatggagcccgaccattgtgcagcggtcgcatcgtgtactgagtacaacgccgagaaacttaggattaaacacacgatgttatcgaatagttttcgttgattttttcgaaaaatttcttctctacaagcaagaagaagagtagatcttggaatacgaccaacacccggatcaatttgaagagattttcaacgtgtttttcgacttttcgcaaagtgcgtgtactcagtacactagggtgaccgacggtgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgggggaaccgatgtagtggacatttcgcaatgcaacatctcgtacacaaatatctcaggatctagattttttagcaagatggtgtcttcggcaaagttgttcagtaggtcaagggctaacatttgaaaggctgcttgtttcgaaattctgccaccagatggtgctagtgagcatttaatttttcaaacaccgatatctcaagatcctgattacctagaaagatgatgtcttcgacaaagttgtttagtaggtcaaggactaacatatgataagctaccaaagtccttggcctactaaacatctttgctgaatatcattatcttaagatattcgcgatcaaaatacagcatgatcactagtgccatatggtggtagaatttcaagttgggtggcatattacatactagaccttgacctattcaacacttttgtcgaagacgtcaactttataggtaaccaggatcctgagatatctgtgttcgcaaaatatcatgctcactagcgccatctattgaaagaattccgaatcaagatgatcatcacatggtagcccttgaactactgaacaactttgctgaaaacaccatctttctaaaaaatctggatcctgagatattcgtgattgaaatattgcatgctcactagcgccatcttgtggcagtttttcttgttaggtagcttatcatatgttagtccttgacctactaaacaactttgtcgaagacatcatctttctaggtaatcaggatcttgagacatcggtgtttgaaaaattaaatgctcactagtaccatctggtggcagaatttcgaaacaagcggcctatcaaatgttagcccttgacctactgaacaactttgccgaagacaccatcttgctaaaaaatctagatcctgagatatttgtgtacgagatgtagcattgcgaaatgtccactacattggttcccccggggcacaatccgatggccacaggaagatgaggatattttcaaagtgttttctgtccactgaccaattggtacagttggactgaagaaatttgtcgaagacatccatattctatcttgcctagctttggatgtacaatcaaaattgctccgcgtgtactcagtacacgatgcgaccgctcgtgtgacgggcctggtaaaaaaagttacacgagcggtcgcactggtgtactgagtacacgcctaaaaacttaggttaaaaacacgatgttttcgaatagttttcgttgattttttcgaaaaatttcttctctacaagcaagaagaagagtagatcttggaataggaccaacacccggatcaatttgaagagattttcaacgtgtttttcgacttttcgcaaagtgcgtgtactcagtacactagggtgaccgacggtgggttaatgataatgtttagttcttccaaatatatataactgattatctgaaaacctaatactaattcatcactttctcttttattttgctttcagaaacaccagcactcaaaggagcaccgctttctcccctcttaaggagtttaagtggtacattgtgcatgatttctcaacagcgtagcgtaagtcacaggtatggtatactgaagttataataatcattcttctatcccatattgatcaccgccctcccttttcctttcaggacttctaaatattccagcaatagacatcggaaactgcaaccatttagagaaacgtgaagatcctgtcgttccagggacactttacttgccgaacaccgtgttagtcgtcagaatccgaatcaacagctaaaataaaagaaaaaaaaatccgtttgcgtcgccagcagtttattagtgaaagcgagaggtgaggctatttgccgtttaaacttacaccggaaacagcgctgtaaataacaatcaagatctcgttcaacattggcggatcgtagcatcgctgcccaatttccaagaataagcgtctcaacgcttccagtaactgtgcgtgtatgtgtttggaactgtgtgaatcggtcactgggaacagcaaaatcggttttccaaagttaaccattagtagattatcgcatccttaggtttagatttatttccgttgtttcagcagtttctcttattacgtttgtttatgttataactggaacttgtttatccttttagttgctagcacttctttattttgtttttgttttgtttcctttttcgttttccactcttagataagtgctgcagtgtgagcaatcgaaatcgcgtcaagttctatcattgtctacgggagcgcagcaaactccacccataaattatttgaaggcagtagccatacagcacagtaaaattcctaatcgagccgtgaaatcagcaccattgcgcgtcagcagaatacacgaatccgtaatccatatacaaatgcttttgatatcaaccgtggaaccacaaatcggagacggagactcaattgtcaccatcatcgacaacatcgtagtaaaacctaacagttgtaaacttaaactgagcggtcccatcctctcgcatcagtgtcagcaaatgaatttggcttgctagacgatataagcttacagggcgacagtaaactggcaggacccgccagaagtccatcacgtgtatcattccggattaaaatcgatcccaagtgagagacaaatcatagttcgttctgagaagagagtataccaatactatcgagattgaaagattttatcttactgattgtgagtactattgctttgtctacattttccggaatataaccgatatgcatgcaattcgcaggtgtcacttgttccatctaagagtaaagtaacgtcctatcgccatcatgggtaccgtaaacgtcaaccgcaatgtggcggatgtgttctaccgttataaaatgccccggattaatgccaaggtcgaaggaaagggaaacggcatcaagacggtcatcgtcaacatggccgacgtggcgcgtgcaattggccgtccggcaacgtatccaaccaagtactttggttgcgagctgggcgcgcagactcagtttgactacaaggtaggtacctctcatgtaaaggtaatatgtatcatgttgggcttggctctgacaaaaaatcataactattaaaactttacgtatcaaaagattacttatgattgagaagaataccattctgcgacagtaataatctatcgcgacatgaaatactagaaattcggaaacagaaagacctaggctgttcccggcacttcgacagaaaagttttaagcaccgtcagtgcacccagtagccgcttatgctcgcgaaaaaaattactattttagctgactatgcctgtccttaaaactatcatggaatttcagagaaaattactatattcgtagtacatcccaccgcccttctggtacatttgacagaattttttttcgttaatctgatttcgattgtagacattgtaaaatcatgtgaatctgtggtctgcttaaaattgtcagtgcgagcgcttaagttaaccattaggaagtagtttcgaccgcacaatttttttgcgtgtatggatacacggccgtcacgtgttaatgtgaaataattatgtcaaatacttatttcacataaacaaacatgttgctgaaactgaattgttaagaaaatcaatgcttaattatcatttttacgtgcttcttaaaaatgcgcaaagtttggagctgcgcaaagttaggtgcgtacacggtagtcctatttgaataatgattttttggtaaaatttcaaagtatttatgttaatcatctgggaaaagctctccaacaacttgcccgtcgtatctagtagacagataggtctatacgctgacgggtcacttggtggtttccccgccttttgtaagggcactaatttcggtcgcttccttacatccgggaagattccttgatctacactacccgccataagtatggaatcgtatcacctagcattgcaacaccccagttgaatattgcagaaccccccaataagtgtagcatcacctaaaaacagtaatatttatgatgtaataactcggaatccttactttctacaaagttgcggtcttcggcaaagttgttcatcagccttatggcatttatttgttgaattttgtatgggttattttgcgctacgtgtgcatgtaaattgggcatattgcagcagattctagctcgtgatcccaacctcctagaaagttcgtgtcttcggcaaagttgttcagattttcaaagcaatttgaggcagcactgcttagttagcaattttgccactacgtggcactagtgtacatattatttgatcatatttcaatatactttagctcataattccgactacctagacagttcgtatattcagaaaagttgttaagaaacttgaaagcaatttgagaaagcacgtgtttagttcgcaactttgccgctatgtgacgatggcgtgcatgttattgggtaatgtttagcaaactctagcttatgactccgactacttagaaagtttgtgtcttcaacaaagtttttaagaaccttgaaagcaatttgaggcagcactgtttagttagaaattttgccgctacgtggcggtagtgtggatgtaatttgatcatattatagcaagttctagcccatgattctgatcaattagaaagttcgtgtcttcggcaaagtagttcggaagctggaaagcaatttgcagcagccctgtttagtttgcaattctgtcactacgtggcgctactatgcatgttatttggccatattctagcatgatcccgaccacctagaaatttcttgcctacagtgaagttgttaagaaagcttgaaagcaatttgagacagcactgtttagttagtaattttgctgttagcaccacagggtgtttaaaaatataattttgagagaaataacaaaatatgcgaatagaaatatttttgaatcacgaatagttaaaagaaagtatgtttctacaaacttgtacacttaggacaaaaatcgaaacatgatggaatataatataatagagtaaagtggggcaagactttcttttaaagatttctagctcaattcacaacaaaacttaaaaacgtcatggtggttcgaatgctattcaagtaagagactttcattccaaatatcataaaaatcgattgagatttggaaaatttatggctatttgttgtttttcaacgtgaatattgtaatttttggtcaaactttcgttacgtggaaccaattgaagataaaatctttttcaataattgatgtaagggcgtttctaagcctatcataaggatgctttgaggtgtattagtttttgcataaatgcttggaaacaatttttggcccatagcggggcaaaagttcgaatcagcgggacaaaagttcgacccatgtataaactcacggaaaaatttgcaaattgcctaaaacccacatgttatcttcaaatttagcaaaatttgtctgatcgtgcaaaaaatgtcaccaaaatttaaatttttcacttagttttggcgaaaaactgctatttttgaataaattacaattaactctgttttgggcaaaattttgatgaaaatttagtgtgtatttttcgtcaaacttaagtttacggctggtgtaaagtatgcctgtaataaaaatatcgatattttgtgttttagccagcgaacttttgccccacacttgattcgaaatcttgccccaccgatggggcaaaagttcgtttaagacaattaattttgaaactgttataactaaaaaggaataaatattttaacacaagtttgttcggcaaaattatagccaatatgttgaacgttcactgtatggtgttagttttgtttcaaatggtattgtttttctggaaactttgattttaccactaaggtcgaacttttgccccaccttactctacaatgtgaatcgatgtatttgtttgtttttataatatgcaaacatcaaaattgccaaataccaaacagtgtttcctcaaattgtttttgaacaactttctagctcgggagcatgatcatgatcatctagctcatgagctagaatatggaataaaaccaaaattacatgcacactagcggcaaaacagttaaccaaacagtgctgtttcaaattgctttcaatctattgaaatatgaccaaattacatacacacaagtgccacgtagcatcaaaatcgcttactaacaagggagggtcacgatcacgacccccggggatttcaaccaagggtggagagcggctgtcaactgggagtaaaattgaaaagccgccaacctaagtccagaaccagttttaaggcttaacacggaaaagtgaaaatcattcttcgcaaaattacaggtaatcaatgcgcttcaaagaaattgtttgcaagcagttatttgctacgtgctactgcagtgcgctgttggcaatttaatcagaaaattctgctgaattcccaaaatagatatttacgagaaaattgattacgccttcatcattgtttggtcgttattttgtatggttgtttacattttagaaccagcgacacgttgaggtagcaataaagagccgcccacccttgatttcaaccggactatttttgttgaattctatatgtcaaaatatggataaatccaaagcctttcgggtgatgggccagtggtgtagccaggaggggctcttaaaggtgccattttttgcacgtcgaatataattttaaaattttcttattcacctaaaaacttcagttttaataccgatagtagtagttacagctagaatgtatcattgtatattatatcatgtattaaaaatgtacatttatcataccagaggcgtaatccggttgaaaactcgtgagtacaattttataaaaacctacacatttttggtgtcaatttccgaccacttgacgctattctcacccttaccatgaaaatggtgaaaggccacatgatttctccaatagtgtagacaggaagggcaaacattagggcattattaacaatggaggagattgggaaatacggtttgttctggtaaaagaagaaaaaacaatgatgacctacgaatgtttttcaaaactacacttctcaaaatgtggaaaatacataaggggccatccataaatcacgtggtaacatattggcaggaggagagggggggggggattctaccaaaagaccacaggtcataaatattttattttttttaaggacgatagaccacaagaggacaaaggggtctgaagatcggaaaaaatgaccacgtgatttatgggcagccccgtagaatgtgtatatttcaaataatatggatttttttagataaaaatattataaagaagatgaaattataatttattatgaaatcagggcaattgccagaagaatatgttacagtagagtagatgatgattggactactatacttcagtggctgacaaataatcaccgttaccataatagggacagcagttggtcaacgtacgtttcctcacatcagaaaaactgtcaaatcacgatttggtggtatttctggatgaggttctgtgatcatatttggttggaagataaaaagttattctattgatcagttcttggacatctaataaaggtttctctataaatctacataccttaaaaatgttgaatgcatcaagagatagattttgcctatctggtatcgcgcaacaccccgatgtgtacttctcccgttcatataaatactttttctggtttctgacagataaactactagatagctaaaaacaacatcaatatttggcacagggactatgttcttcgagtttaatcgtttcaacccaatcagtttacttctaaacggtttgaaaaccttatatggtttgatgtttttcaaatgcgattatattgcaaacagtggtggaaagaatcatgccgtttacgcaaaatgaaccaatattaagcaggatccacactcacacgctcacgaaccaacagcgaccgatttggtcacagattcttgcatcggagaaccagaacaaaacaaatgtaaaaagagtgtgattgctggatgagcagagtctgctcacagccgttcttttttccgttcctagctttttatgtgaataattggatggattatgattataatagatagattacaaactaatgtacgacagtattgaaacaagtaaccgatttgtggtgttattgtagaaatatcacagggaatcggacgcgtgattgcatgtcaaaataaaatgatgcgatgccctttacagtatatgtgttcgggcgatcgtgagcaaagaaagtaagaacgcaatcgcacaaaatgaaccaccgatgcagtagcatttttatggtgtacatgaacagactctgttcaccgttttacagcactgattgcaaatcatccggaacccttcgatacgttaataatactttatggtcaatgttttgcaaattggcagacagcgatatgtaagatatatattcagtcaaatctcgttataatgtacactcgatgtaatacaactagacattaaacatacatctatgagccctttgaagttgttttcaataaatttttacttgtacttaatgtaccgatatttactgttaaatccattcgaatggaaagatatgcttggtgtcaattttaaaaccatccgtaaactatacacaaaaaattgattttcctctatttttatgtttaatatttaacatatttttttattattgatagttgatgcctgattcagtaggatgttgaacagaaaaagaagtttcaaggtatgcaactaatgtagcttggtataattttaaattaacttacaatatgtttatattttttttttcaatgaatgcctacactggcgacactttcgattcatataaaaacatacttatgctctttcatattttgtgtagttcaaaaaatagccaatagaatcaaccataagccatgtcgttttcttcccttatcagtagaaacagtattaccttatattctacattgttatattcgatattacattgttgttgtattacattgttattgtattcgatatgcaaaaatttgcacctttaagagcccctcctggctacaccactggcccatcacccgaaaggctttggatttttccatattttgacatatagaatccaacaaaaatagtccggttaaaatccccgggggtcgtgatcgtgacccttccttgtaaacagtgtagcctcaaattgctttcaagtttctgatcaactttgccgaagacacaaacgttctaagtagtcaggatcatgagctagaatctattggaatatgaccgaatttcagcacactagcgccactttatagatggtcaggatcatgagctagagtctactggaatatgaccaaattacatacacactagcgccacgtagcggcaaaattgtgcatccaaaacttcacctgaacaactttgctgaagaccgcagttttgcaggaagtaagaatttcgatcttatattttttaggtgatgctaaacttttcggagtgctgcaatattcaaatggggttttgcaatactaagtgatgcgattccttacttatggcgggtagtgtatgtagcgttgcatcggggttcctaacatgtccggatccgcattcactgctgcttttaaggcaacattcaggctactatcgggtcccggtgacttgtttgacgcgacttctgccagttcttcgtttgtcaccctcgccacacattctccttcatctgccgcatacggcgctgggggccattggcttgtaaaacaatgcgggaagaatgcatcgattatcgaccgcagcaactcgggcgacttctcttggggcgctatgacacctttggtcttagccattaccactctgttacagatatgaagatactctatgccatgaaaagttgaaaaaatgtcccttacgaatagatcctcgaccacggattcgaacccacgttcctcagcttggtattgctgaacagctgcgcgttctacgactatctgggctcctagaaatcttggtatgcgatcgcgaaattccaatacagagctaatgttgattttcatactgtgacctataaaaacacatttcctcgacacaaaatgactatcgtaagcaagtctggttatttagaatacaggtgaatattttgggtccagtttcagaaccaaacgaccaattttcatcattaggaaatacccattattcgaaacttcaaataacacttttttataaaaattaaaacttttggagagatttgggctccccaagcacctaaacttcttaccacgtctacgccagtgaaaacgttgacctaccattaggcaacgaaacccgtaactgggcaccctgagcacccaaaactcaggtggtaagtcccacgtctgcggccgtatcaacatactgaacaacacacaacaagaaagaaatctggatcctgaaaagaaacaaaaatcaataagttaggcacaattgtgctactttgtagccaactcacccaggctgtcagtcgatctcccctccgtcacgatacgatacgatgttttggaggagagaaacagcctcctacataaggcatatcgtcttgaatcagggatgctgccaggatcaaccttttactgaatcctcaccgctgctaccggtcgctcatcggtccaatagctggtgggtggtctttccccgcacccgtcatagcctctttcgctgggcacatcttcgtaggaggaacagaatgctggcgaccaacacccacgagtccatcactggtactgaccagtccacggcggttttggacagacccggagtttgcccgaaattggtggaaacaagagagaaagaagaagcgtgtaaacgttaaacgttaaaaaatacgttgtagtgatttcttttttattcaattcaaattttaacttgtagtattgttcctttcgtcttacctgtttgtttgaatgtgttaactgtaaagtaattagtatcgtgaaatctgtgaaaatcttcaatgtaagctgcctaggctagcccacctggccagattttttgccgttttaaagtggcgaactcgccaagggcgaaaagccactcaaataaagataaataataatacttttggagataaagttcgggcattctggacgtatatttgccattttgggctttgtttagtagtcccggattgttgtttccagtatttgaatttagtgtatttggatgtggtcgatcgtcatgttgaaactcaggtttagtaacaaagatccattttcttattttggaagatcaatgctttattttctgaaatgttgattctattggtaatcctgaaaaaagctaatgagaatctggaaaatttctaataaatactcacagcatattcaacgaaattctcataagaatcctcttcggattctcatcagaatcccctcagaagtctcatcagaatcaatataatccgcttaagatgttcaatataatcctctcagaatttgcatcagaattctctcagaagtattaaatgttggatctcctactcccaatatcataggatcctattcttttaggagtaggatctcatcaaaagacatctacgaatgttatcagaatccttccagaattctcatcgttccaaggaatctgatgtgagtcctgaaacgattctattgaaaatcctgagaggatcaatatgtagtaccaaaataattctaataagaatacggagagaattctgacgtgactccagagaggccattcctaaactacgtgctcatttatggtagggatttttgtatgatccataatcacaagggggtagatggtcccacgagctgaaaaaaaacctcgtagcttagacagcccctataagaattctaatgcgaatcctgatagaatatttgtaaggaaggagtctgttggaaatatctgccatagaatatcggaatcggcgttttttttttctaattttgacgatattccttgttctcttacgttgatattataatagtaccaactaaaatctaaaaacctaatacacctcaattaaacttctatcaaatcgattaattatttcttccagaatgaacgcttcatcgtcaatggatcgcacgacgccaacaagctgcaagatctgctggatggtttcatccgcaagttcgttctttgcccggagtgcgataatcccgaaactgatctgatcgtgtcgtcgaagaagggtaccatctcgcagggttgcaaagcgtgcggattccacggtccattggaggtcaatcacaaagttaataccttcattatcaagaatccaccgaacgtgaacccagcaaaccagggcgcgtcgttgactgagggaaagcgcaaagcacgtgctaagaagggcggcgaaaatggcgatgactcgaacgccgctgacagcactctggatgcttccaccgctgccgatgacaccattgatggccaagctggacgcatgaacggagatgacgatgaggacgttaactggacggtagacacttcggaggaagctgtccgtgctcgtatgcaagatttgactgatggggcgaaaaacatgacagtttcggatgattttgataaaaccgaaaaggaacgcttggacatattttatgagctggtgaagaagaagcgcgattctggtgaactggagaatgttcaaactcataaggaactctttacggaagctggtctcctagatatccaggcaaaatcgacccttgtactggctgaactattgttcactgctaacattgtccaagaagttcgtaagcatcggaaattgctgcttcgtttcacccatgaagacctcaaagctcaaaaatacttaatcggtggtctagagcaaattttctcgctgcatgctgataaactaatggaaaaagtgcccaatatcttcaagctgttctacgacactgacatcctggatgagaagacaatcctcgagtggtcgcaaaaggtaagcaagaaatatgtctccaaggaggtagctgcgcaaatccacgagaaggctcttccgttcgtcaagtggcttcaggaagcggaagaagaggaatcgtccgaggatgaagatgactccgatgtcgagatcgagtatgatgatcgtgccaaaaccgactccctgcgcaaagaacctgtcaagcaagaggtcaagaaatcgaagcctatcgaggaggaagaagatggtgacgatctcaacattgatgaaatttaaatgtgtgttttctcccaaaatcaaaccaacaaaattccctgttctaaatttaaacattcatttttgaaatgccatttaaaacaaaagctgataacagtatcacaacaaccaaaaatctattgcgcaattcagtagcaagtaaaaagtcacaaacattataaacatgattgtttgaagctccataggaagcgacgatgtttgtaaatgttggtatgaacaaacatgtcagataaatagcaagtactgattggtcaattttgagggtaaacgatttcaattctataaaacaaaaattcgtttgtacaagtttgtaacccccattctttagtaataataaatttcaaagttaattttgagcgacacgaatagcaatattttttgacggggaacaatggcttggtttgattcaatcttttcacatttttaatactttatcacaaatttgctctgggtttaaattttatgcatatgttccatttatcacaaaaacttgatgcttttaatagaatgttctattcctacgcataaataaaagaaacctaagcaaacaaaatagggcaggcatcggtttgttcgaatggaaaactgaaataaatatttaaagatacgaataatattgtaatcaaattatgtttatcagcaaaaatacacaattcaaaaaacaatgaaagtatgaaagttcttagaaagaaactccttataacaattcttagggattttgtagagtatgggacaaaaaaacgccgaatccgccgaggagttggattgagctctattattatttgtttgtaggtaatagagtggcttttttcccttggcgatttcaccactcagcaatccgcaaagcaaacaaattgactagatctgtagaaaattgttccggattaaaccaatcttcacacaattttagcatcctgagaaaactactaacccatgatttcccctatacgcaggcccggatttgcggggatgccgagggggcaatattgcagaacaagaacataaaaaaataaattccggataatcaagtctaaaagtccggataatcgagcccgacctgtatatatttatttaaaaatttaaaaatatctacacaatgaaagaaacgttaatcacttcgcatattgctgcaatgccgactgctattcaagtccttaatcggaaatatctgaagcaaaattggaaaaatattgatgcaatctttgctactgttatccaagtctcgatgaatcatatacctaatattcgcgaagtaa

SEQ ID NO: 160 - DNA, 14526 bp, Aedes aegypti
acttcccaccgataaacaacgatcggcaaaaatctccatctcccgttcgtgaagaagcagagcaacagaacaacgacgacgacgacgactggactgatgatgacaatgcatcgaactcttccactgagcacaatggggctacaaacaagcgacggcgatcgaggcgggttaaccaaaagagtggaataaaaaagatttgctctgatcagtgttccccaaacacggatcgcacggaaatcgatgtatcaagaaatgatacaaaatgtttatcgaaaaataaaattgtagaggggggaaattgttctatgaataatagaaaatgaatatcggctctgtaaagcttgttacggcgtgtgagcctaaaaataaacgatttggtaaaatatatttgaatcgatcgttaaaaagttggtcgatgggcaatgatgagagtgtgacgtctgtttctctgtgtcattaagttatgcgaaaaataggaaaagaaaaaaaaacaactaaaatatgggtttcacattttctgcgtgtagagttacatttccgtgtggggcgaattgtcggcataatccgatcctgtactaaaatgttctaaaagcacacactccgaactgtcaaacgccgtcaacaaaatttgtaaactcatccatttttgcttggctgcagagtttagcagaaataaatttggaattttttacgataaaacaaacagttagtgcatagaagaaaacgttaattgttgcgtgaatagttgagtttcctgtatcagaaatcatgtacccaatgtcagcggttaatgccggaccgttctggagcaacggaccgagccccggagcattctataattttcccggattccaggccggcaatggtgccgtttcggctcgttcggaaactcccggcgagtatgggactcagcggtcctagtaagtacccctcgggggtggtttcatacaggaggaatcgaacacaatcttccaatgatttttggtataacctcaaattgatctacgattggagttccgcaagtcataggtaatcctaatataacaatattcttcttttactgtagcactccggtcacgacgggaacctccgtggtgggactgaaatttgccaacggtgtggttattgctgccgataagttggtttcgtatggatcgctggctcgctttcacgacgttgatcgggtttacaaaatcaacgacaaaaccatcatcgggattggtggcgattttgccgatttccagtacattaagcgtcacatcgatcagaaagtgtaagtatggggtaatttgtcgattataatggtagtcctggtagtcctctaaatgttacagctcaaataaaattcggagaatattcatataaaaagcgttataataacgggggatgtgggtgttaaaaatgagtactcttctaggggatggtacacaaattatgtcacgctaaatttccactttttggaaatcatggactctcgcacaacattctactgagattttaccattaattcttcaaccgaattctctagttgtattctttgagattttcctctaattcctacaggagtttttcaaaaaaatcaacgattgcgtattccaaagtttttgaataaattcgtttaaggtgattataaaacgaagccaaactttgaatgaattttcaaaagcacaagactgtagaatctgacaacagatcgcattgaaaatcaatcaaattacttgcttgctggtgatcaatgggatacattttcaacgcggagcgctgtttagttctcaagtcttgtgctcttgaaaatttgaaaaccttaaggaatttctattcatcgatcctctcattcacatattagttcgccaaattcaatagatctgtaatacttatagttcgtgaagccagacataccaagacaagaacctacagcacgaaaacatgttacgaaatgtgaatcaattttcttgcaaagagcaataaagatgaagagaagtcgatgaatgaagataaacccttatgaaatatctatgtcgatttggattacacatcagcaaagattacagaaattattccagttatttctccaatcatttttccacaagcaataataactgtgcttttatccttcaccgctcatagtgtctgcagagcagcatcacgattcgataaaccaatttatagatcaatattataaacttgttattgaaatgagtactcattaaagttgataaataaacaaatcaacattgattcattgccaaaaaaaaatactacaatttcgatacatttagtattttaacaacttttgttcctgtaattttttttcgaagcatttctttctgtttaaagcaaaattggcgacaaaagtgggcgggatgggattaaagcactagtccgaaaagcaggttctgttccagagggaatgtcatgctcatgcctagaacaggaaaaagaggcaatttatgtagaaagttccctcagacatccccagaggccaacatttctttcagaaatccttgcagaagcttatcaagaatttctacagatttttaattactttggaatttccttaagaaatacctcctggatttcttcagaaatttccccaatgttatcttggcaattccctggaagattttttggatcatttctttgaggacatccttgaaaaaaatttcaaaaaaaatctggagaaattcctgaagaaatcttaggaagaagctcttgagtatttcaaacgtgtgctgatcgatttctctacaacaatcttgtgtcctcaagtacctagaaacatgctaacgtaacaattttgcttcttttcaaattaattcgcagtgttgtgaaaacctcaatttctcataactcacgtttgagatttttcatgcgtgagatgtcaatcacgcaactcagcagtcaaaaaatcatggatgagttggctcaccttttttactcattgtctcttatttccacagtttacacacggcaataatttcttgttagtctggtaaaattgtagtaatcctttctaacgtaaacaacaacattcgggtttcacgagtttttgacgggttttgcgactgaatcatttttacggtttgagttgattgagtgattttgcgttaaaatctcaagcgtgagatttgcgaagcagatctctaacgagtttactctcacgggagagcgtattgattgaaatttgagtgtgagtctatcaacgctgcgcagcagagagtttcgtttatgagaaaatgataatgttttttatgcccttattctagcacacgcaggattttctgaaagtatccttagtaaaattactggttaaaatattaaccctttcttgtcctattgttatagctattctttttaatacttacgttacggtcggaagagtattaagatagcaacaagccaccaagacccacctattcgtcctagatgatgaggaagtcgaagtgaaaaaatgactcaatcagcatctgaggttggtttcgttttaaaagcagggtttcggctacctggaaaaacctagaaagtcagggaattcaattttcgatctggaaagtctgggaatttcacttgaggtcagggaaaaaaatatcaatattacaacatcaaacgagttgactgtctgcaaagttatcgatcagtctaagtcagcaacactatagttaataatcatgatgtttacaatcaataagatatatgaaaaaatgggtaatcaatcttgcaacatcaacaatgctatctgaacaacttcttctaagttggcgtggattgctttgaacatattttgttctaaagtttccttgatcattgctagttccgcgcattttgctcaatatctaaaaaaaatggagttcatgccaatctttacaagtttgtatagagataaaccaataaggattctcgtattttagtgaagatgaatagatgccgtgtctcaaaatttaaagagcacatctggtgaatcaaaaaatataaaagattgataggttacaagttggagatgatcaatcgatcatttttcaggtctgaacactgtttagtttttaagatttgtgcttttggtggtggtttttttcgttgaatgttttggacagctccactctagttatatttgatgtaaaattaaatcatgagaaactaaatctaaaattttgtcgaaaatacgtatttaaagatataggatatttcctgatttcttttttcatgttgtttctgaaaacagtttattctgataataatgcatttcttcaggattttcatcaggagctttccaagactaagaggaattctctaacaatttttagagaatcttggaaataaggagcttttagaggaattcttagaatagttcatcgagaagtattggggaaattttttttttttttgtatggtattcagttggagctgcctgacagcttaacttgtcaaggctgaaccctcggtctggcttttgccaagtttcccctctaccaggaccaatactcagacggactaggcaatggcgcccacatgaacactgttttttattagtattgtgacgtggtagtttttgaaaagtacccacattcccttgcttctgagaaaagaagcattatgaaaataagcagctccattagaatttgtttgaaatagtagtgtagaatttgtttggaatagtagtgcattactaatactgtctagtcgaaatggttttgaataatttgtcaatcaagtgctattctgattactattgtcttttacgtaagattagagtcttaaatgtcaagtgtcgtcaagtcttaacaaaattaggctgtttagtagtagttctagttaatttcattttttgttgttaaaagtatttattggtcattacgttcatatatccttaaagaaaaaagtcgctttccttgtctgttcaacaatttttcgaaactagcaagtgtaccctaatgatcgatctcagcgtcttactttccatagtcatttttatagtgaatattgaagagtaaagttaccttaggcttctattacagtctcctacaagattcacttttcggtggcaaatgcaatgcttcacaacgcctactttctacttgtaaattttgcgaaaatgaagctggaattagattatttataccgctgttacaaaaaaaggtaccgtaatccggggtaacattgatcatttttttttagtttttcttaattttttcatttcacaatacaaatgttacaagtttcatatttttaaaacacgtactggcacccaccgctctaaactatatactttattttgtttttgaaagattaaaacatgtttaaataaatgttttaaatgattctttgattcagcttatatggggtaacattgatcacccaagtaaacaacgtttggtaatattggaaatgtcgttacttaccaaaccagggctcctgaagccgaatatgaaaaccaaactcttacaagtcatttactttttgagttatttcaaaaataaaaacaccttgaaccgcggaatacgcctaaaagtaggcaatttcctaaggaaattccacattcctaatagtaattagttaatgttgcctaattgaataaacttataaaagatttgacaacggaatcgttttcggcgatgccatatttagtaacgcccgcatttttcttgatcacgtcgtctgcagaactcatgtaagacatgaattttcggtagtgtcagtggaaaggatagaaatcattgtttcaaaaagttgacatattttcacatgaactaaacgcaattttacaaaaaaccttaattttcattagcttatgaatatacaaaagagaggcaccattcatgattcgaaaatgtttcatcaataaatttgtatttgaacttttaacgtgatgagtcatcccgatcaatgttaccctggattacggtatttcttattatggcaatgtaaaaaccatattaaaataagattgtcgccacttatttctactcagtgaatctactagtcattttcctaagagttcctaagtattccctacgtcgtatatgataattgttaatgtccacttcgaatagattaattatttgaaatgggcatcaattctatcaatgacgcagaatgtccgttggatcacatccgagatattattgcgtctatgccatatgaattatgacgcggctttaagcaaaaaatgccaaaatgtgataccaccactacaggttacgcctttggtttccatcatatgggctaatggattatgccctcccatcgcggcaaggtcgcataaccaaggggaggggagtattggggaaatatttggacaaatatcttaagaatttcaagtgtattttctgagaaagttatgtgggattccttgaagcaattctccaagaaaagttctttggcaatggctagaatttaacctggaaaaagaaatatccaatttttgagataaaaaggatggtgggtgatcgtaatagtgttgggtcttgtatacaaaagttataatcaggaagaagtccaaaattgtcgtttatggctgaaatttgtgaaataagatcagtaggcgaattccggcgcgtattttcttcgaagaaaagcaaattttcttgctggtgcgtaatggaagaaaatttcttctcttcgaagaaattgttcgcaggaattcacctacataggtagttcgctagcttagaacatctttgttcttactgatttccaagttggaaaagtaaataggatctcaattgctcaggtttatcataacaacttgaataaacgttcgggaatgttttctgacaggcacatataactcagtaaagttaaagcttttgctcagctcatttatacgacctaaaacataaacatcatgcaaatcgtcgaatatttattttcttgtacaagtcgtacttatttcggttcaaattaaccaactcagtggtctggatttttttgttgtttttggtcagggaaagtcagggaattttattttcaaaagtcgacaccctgtaagagatgttctttccgagttcaaatacttatcttttgatatctacgaggtaaacgattctgaatcagtggagtagtagacgtcccaagtaacaattcaacagcaatttggtgtggattcattaatgttttataatagttagaggcgacatttaacgttgccaaaagatgatactttgtaattcgactcatggctgtttttaaaacctttaagaggcaaaatataaagtcaaaatgttatggctacaaaatcagctttattgcagcaagaggttttgggagatgcgatgaaggaaaaaataccttgaccgtggttttatgggcgtctatttatagcaccctggaagtaattcgtaaaactgaaattgttacttgggctcctaccttctgtttctggaatgaggtaagaaactaaaatgtatgatgcgatgaaacctgtcgcaccttaaaaggggctgtccattaattacgtaagggtttatggggggaagggggagtctgagatttcttacgcgccatgcaatttatttaaattttcgtgtacaaaaaatcatatcatggggggagggaggttgaaaaaccccgaaaattgtcttacgtaattaatggatcgcccctaagtaggagtaatactttgatacgttagagtagcgatgcatgatcaaaatcagtatcattcaaccagctttagtggccgaacatgaataaggggaaaatgagcgccctttgagagtttgattatgacaaattattttcttcaagaggtataaatagcggtttctttttctaaagaggctctttgcacaaggataaagaatgttaattatataaaatacgactacttcattatttctttattgtgatggagtaggattgcattcaccaaacaaaggacacgggtatagcacaaaaggtcaaagaaaactggtcatagtgattcatcccgaacaggagctgtgagtaaccctttctttccctcgccttttttttttcgacaaaattacgtttctgaaaaaagcgcttgaataaaagttgttgcaaataagctacagttaaacctccatgagtcgatgctccattactcgatatcgactcatggaaccacactaaaaatcaaatttcatggttactatgatggtccctctaaacgactttctatagcttttctgttccataactcgatatttccatgagtcgatggtcccttcaatatcgactcatggagggttgactgtagtttatccaaaattacttaaacaattttgattgagtttattaatagtttgaccatttgcttatgttattcgatgtttagtgagacatatgagcgtacaaatttaacttttttttttttgttaaatatttattgacgtgatttgtttaaaatttgattacaacatataagcaattcacattcaaatagaaatccaaagagtttacatccacaacattattaacgttattaacaaaggagatgtaatgaatgaatagttttaggatatgtattctacgatttctctctataccatctaatgatggtcgaattaattcattgaaagtgattcgtctccatccgcctagatgagctgttattctacgttgaaggaattcccaagctgcgttgactcgttgacactcactgtatttgtgttgcagcgtttcaattggttcgttgcaatacacacaattttcaccatccacacgacgcatggtgtaaagaagctttcgatagtcgcccttctcgttgacaagcatgaatagattggatcgttctgctgctgtgaagcttcgccagtggagacttgaccagatccttctccagtcaacttcaggatactcctgttcaactttaggtttgtcagtctggtcgatgtacatgcgatggatttggtcggccgatggattttgaacaatttgtataggaagttgttgatattgttgacataatactttcaaatcgggcagatcagctggaatagtttgggttgtatcacttgattcaacaaaagttttgtaaaacggcaaacattccagatcttgtacgtgtcggttcaccataagtgctttacacttcatagccggtaattgaagcttcagtcccccgtctttacggtcccgtgaaagttgtgtcataggaatgcgtgtgggaatcccactccaaataaatctacctagcgtagatgtaatttttgctatatgtactgcatatggtgagagaagataggtaccatattttagacataatgaatatgttcgcaatgattattgcgggtgattacccgctggtgtaaattcaagcatcgcatagagtggcatcttatttgatgcataaaattattaatcgctgcatcccagttgagttttaccatcaaacgtacagaattggtaaacatcacgccgagaactttgatggtgttgcccgtttgtagccatggtacgactaagggatctctttcgatgagaccaatgtcgatcgctttggttttttgccagttcagttttgctcctgacaccagctcaaaacgagtgaaagtttctctcaacatctctactctctgggtagacgagcaaatgatggttatatcgtcggcatatgcaacgatgagatcttcctcacatatcctctccagctctttcacgagcgggtgtagatatataacgaatagatgcatgctcagcggacagccttgtcgcactgagcgttgtatatcaatgggtggcgatagatggccgttaaccaatagtcgagatgatgcccgatcagcaatttgagcgaggagatccacaaggtgtccgttaaatccaagtgagtgcatggtttgatgtaagaaggcacgacgaactcgatcaaaggccgaatcgagtcgaatgaaattagtttggctctctgtttacgttttatcacctgagccaaccgatcttttaacgaaagagttgcttggaagatatttcgtgatgaattagcacatttctgtgcgctggagagtatatcgtgagttctcatgattgtctctaatcgggattttaggattcgagagagaagtttataatcgaagttcagtagtgagatcggtctatacgaccgaaccgtttcgtctcctcctttcttcttgaccagcacgatcaccccatctacacattcagctgggaattgaccggacagtgcttcgttgagtatcaagttgatctctcggtgtatgacgtcaaaggttctcagataaaattccttcgggatcccgtccgggcccggcgattttttcgaagcacttgtttttattgctgtgatgatctcttctgtacatatagcactcatacaggcttcatttgttgcgtcgtttattgggattgccctctcactttggaaaaagttgtttaggccgttcctaactacagcctcttcagtatatagcgatgaatagtactggtagagatgttgttctatatcttctgatgagtgtagtatttggccgtccacgctttgtagccgggtaatagtcgtgcgtttacgtgttctttctccaagatgaaaagatgagatgtcttccccggcgataaacgattcgttgatacgtgtgaacatcttggagaatttgcgctgaagcgcaagcatttgtgcttttaacaagtgtatagtggtgaggagtgccggttgtccatagaaatcatcgtatgctcgacgcagttgactgtagagcctttgatgttcgcaatgaaattcgtcgtacgctatttttgatttccagcggaagaaggacttgagttttcgtttggcacagagaagccaccatgccatccaggatgcataattccgtcgttcccgggtccagaattgccagcgatagcgcaactcttcaatgatgagggcggagggtccagaaaccgcgtccgggagctctgccgagggacgggatgcagatacgaagagtgactgcttggtgatcggagaaagagcaaacgtgagttgctgagttccgaaggtgttgttggagaccacgactcacgtagaaacgatcgagccgagaggaagagtttgctgtcacatacgtatggccactagagcggggacatagttttatccaagcatcacagagctgcagttgttgagttgtatttttgagagcgggactatcattgctgcctgttgcgtcgcattgccggaggacacagttgaagtctccggccagaataacgttcggagtattgtgacgtaagtaatacgaaatcgttctattgaaaaacctctctcgttcagctctgaaggctgtcccggagtgtgcgtagacgttgcacagagtgacgttatttatgcgaagtgctatcagtcggccatctaaacttctctccacattagagaactgaatatactctttaagagctattgctgtgcctctccgcatgtggtcgatgttgcagatgacattatagcccggcaaagtgagttggtcattttcaacctcttgaagaaatattatgtccagttccaaggtgcgaagaaaagtccaaagtgcatcgatttttgttgggctagaaatgttgtttatattaatagtggcgatgttgtagctggcgtgatccattagcggtgtttcctttctctcgaaccttctccgtcatgtgtgcgagcttttttaccaggtggacggccgcggggttttgagctcgaggaatcatcggtttcttcttcatctgaacgattgcttctggttaggttttcgtcgttgtcgattggctgttgttgcaatgtcgttttttttttaatttgccgacgggcagtggaggcagttccacaaccaattgctttacagcagtcggtggagccagtgatttcgtggtgttggaattcgaagcggaggacgattgacttgatgtgttagccacagctgatggagttgtatttgtagatctcggacgcacaatagcaccggttgagggtttttgtttagcaactttcgcatacgattgcttgttagacttgtccgcggacagtttttgaagaagaagtttcttattttgcacccaggatgctccattgtgtacaaaatcttcgcaatggcggcaggtttgatgctgcccaaaatattggacatatgtaacttcaccatcgatggttacgtaggaaggaatgttcactttgaccatcattcggacaacccataagccggtgggaactccactgaactcatacttgctctcccatatctgttcggaggcttttaacacttctccatatgcactgaggaattcttcgattttttgtttagacacgtcttctgaaagatcgaaaagtttcacttcgacggctccgtcttctagacgaattcgtagcttatacggtttgtcgtctactatgacttcatgtacgttgtcatggtcagataccactttttgagccacaactagactgcatactttcacaaaagcacagccagcgctgcattgtatgcgcagaacttcttctttcttcaaacctaagtcattggcaatgaaacggtgtaggtcttcgtaagatggtttcttgggcacactcgaataatcaattcgaaacgtgttctcgcgccgactcatcgcggttttcgcgcgtgaagctaaaaaaggcgaaactcgccaggcgatagcgaaacgaaatcaggatagcttgcgatcgactctcgtagcgaaacaatagcgttagaacaaacgactgttcggctcagaggttgagcgataactaactcaatcataactgagctaatcgtaccaatttgattgaacgcttgtcgaaaatagcttaaccgctaccatggaaaaaaatggtttaaaatgcattgaacgaatctttaaagaaattacttgcttgaaaatagtaaaatttaaatttcctgaataaaaaaaaatcagtaatatcctagaagaatagtctgcttggattttctgatgaacccttttgaaaactcctgtcttatggttcctgtttagtctctttttctggcatgaggtctctaaagttcctatttctaagacagtcagtcgctaccatccctgtataatgtttattgcgactgaacatgttttgaatcatttcaccgttgaacttaaattccatagcagaaacttatacttgcttatgtttatgaacttatttttaataccaactcaatctctcttctagggtcgacgacatgtgcttggctgataagaatgagttgaaacccaaatccctttacaattggctcacccgtgtgatgtacaaccgtcggtgcgatttcaagccgctctacctggacatcgtggtcggaggaatgcaggacggagaacccttcctgggccatgtgaacctacgtggccgcgcgtataccagcaatgtcgtcgccactggttatggcacccatctggcgctgccactgctccgagaatactcggaaaatccaaccgcttacgccggcctggacaaacagaaggcctccgaactgaccaagagcgtgatggaagtgctgtggtatcgcgattgccgaagcgatcccaagtattcccaggccatctgcacgacggacggcgttcaagtggatgccaactgcttcgtgaagcagaactggaatctggctacaatgattaagggatactagaagcgtcgcttgcgaatttgtatgtactttgtatttgattcaacaatcttttcaaataaatcatcccgttacattcggcttacttacgtacgaatatggaaacattacatgattatagaatacagaaagaaatctatataattactgatagggctgatagcaagtcactttttagtaacttggttaaatggttactattttcgacctcgtcacttgttttacagaaatagtcactaaagtcactattttctggatcctatcaaataagttggtttagcttctcaaactaaactgcacatactcgcataacagtcccattcatataggaaatcccatagaacatgggacttttatacgagtaggggcagtaaaggatgtccggtcattgttgcaaataaaagggcggactatagatataaaatattcatgtaaaaacggtaatctttttaaactttgaaaggattgaaaatcgatttaaaatcaattatgtatttttaaaagtgtttcaaaggcacttttttgaactgtttggtgtattttttctcaaatttggtcactaaaatcattatttttgaattttgatataccccttttccctaccatccttgggatgtaaggtgacacgggagaccgtgttattttccctaacttttgtctcactctaacaattatcatcaaactttgtggaagcaaatctcgagttctagtgaacggatgaagctgaaagtttattgggtcgtgcactacatacagtcgaagctcgttataacgacaacttttataatgacaaaagctctctatagcgacatttttcggtcccttgaaacaaatgttcatgttatgatcattccctataacgacttttctctactacgacggtcccttgcgatgtcgttataacaagcttcgactgtatatgaaattatattgataaatttttcgc

SEQ ID NO: 161 - DNA, 19017 bp, Aedes aegypti
ggtccgaacaagaatcgaaaagggatcaataagtagaacattgacttatggaggtttgacagcattaattcccacaaatttgaacagattcaagtctaacatgtgtatttaaaactcaagtgctcggaataagaatcaaatgatattttctgaagtaatttatcaaaccttaagtaagtttttcaccatcaacgcacataaaatacagcagcttcatgtgaatgaacccacacaactccctaacagaggggcacgaaacagaacaggcaaaaaagggttgaaggacctacgatcgagacagttgacgcatcatctctcttatccgctatccttcggttattgcagtcattaggaaaatgcagacacgaacgaaggagctggcagacacccgaaaaaagcttcgttcgaaccgtttacctataagatgttcctttttgttcagttcagtgtctgggattcaatggctggaagtggttgcgacacggcgggttctaaaaataatcgacacgataaagtgtgtatcgaattacgttctctgtgaacatcagacgggaacggcgtaacgtaaggccgcgaccagccagccagccagccagccaaatgcgatcagtgagttcgtgatttgatacttgctgtcatcgtcgccggatatctctcagctgatcgctgaccaccctcaatgttcccacaacgaaactaattcaggaatcttgtttcttttctgctttccttttcagtacacgccggaggaatatactcacgaaagcccggtgtccgggggacagaggtacacatcacccaaggcgggtggcggactgtaccaaccagatgcgtactatgacgcgccgggtggttcctggtatccctcatcgtccagcggtgcttacgcgcctcattcggcaggttccgcatatcacaacgtaggccacggagcgcacctcggtggaccccagcatagccatgaacagtacgcaatgtcgccggtcggcgttccccacatggatggacatctaagccaagtgagttgtgcaagcgcagtctcattcaaacgtttaagatctaacatctgatcgttatgttttttttgtagaatcaaacacaagcacttccaccgatgagcacgttccggggaaacaccgcccagataccgccaattggaccccagggacagaactcacccgcaatctacaacgcaatcgcaggacatcacaatcagcatgcacagcatagtccaattgtacaaaatgacaccctcgtcggcaatgcactgaaaacggttagtagtgtggggatgattctataacaaatacctgaaaatcatttacccgaatgacatttacccaaatcacactgaactctgaataaatcaagttcttaagtgattcttagtacaatggaattgattacactttgatcatcaatctgataaaatagtcaatgttcgtctgtatttagaacaaggaaaacccatgtatttttaacttaattttgagttatttatctctccatatttcattcgatcttcccgttgttatcagcgaggagcaaaacaatctaaaaccgaaccttagcgcctcaaatttgttatttaaaatcccaataaaatagctttctttcacaagtaactaaaaaaagtgtctgtttatgatactaactaacgcatctgctcttttttgcgttagaagagtgaaaaaggtgcactttgatacatattccgactgaacatcctatttataattcaagtacaatacgcctgtttgttgcatgatgaaattttgttgtttcagagggcccttcgaagagatctgaaacgggccctgtttttcaaggacgcaaatgttccaaattcgctgaatgtggtctttttttattatatgtcactacgacaggatatcaacattttcagataatggcgttttgtgcatttctcttgcagagcacaatattgcatgtagttccaaatgctaaaacacatttaccatggatgtaataaattcatcattgaaccaccattcaaattgattatggttaaagcatttttggttcaaacatttcatatatcttgacttatttacaatcccagtcattatggaagattattagagtagaaatggagaaactaattgaattatagcacttaaattcgatttgcaaacagaaaaaaatagaatgaaaatacttcaatatgttgcttaaatggtgacagataaagctatttcgtctgcgacttacagacttcttcagtgtggagtgctcgacttcgatatttcaccgtactacaccattcaggcaattgacattcgggtaaaggtcgcatttgggtaaatgtctttcgagtgaatgattttcaggtatttgttatagaatcgagttggatgccatctccaagtcttcatgttaccctttggatctaatttcgtgtttaaatcccgcaccctatcgcccccttccccccgctcggaatgtagatgtaccccactgatcagagtattagcagttacggttcaaacccaacgacaccagtgaactcacctcctccactaacatcacagcagcaagcggcagcagccgccgccgcagccgcagccctcgcccaacagcagtcttctgcggccgcgagtatacacggctccggagcgacggccggttcgtccagcggcggtgcaggttcctcagccacgacgtcctccgcggcagctgcggcagcggcagcagcagcagtagcagcggccgcttccggtggaccctggcaacaaatcaaccctgtgatcaacaacggcgctggaccggctggagcggcaggatccgcggctgccgcggtggtagcggccgcagctctcaacggtctacccaacggttcctatgcccccgaactagtgcaccgaggcctgcagcacatggtaattgcaagatttgctcactctgatcccgtttttgtgtcatcttgatagcggaacttatgtattttcggcagtttcgttctcttcatagtcgtaaacgtgcagtaatttagtaagattaagtcgtaatgaaaatttccttgacacgatatgcacatgcaaaaatggtctatcgacaaagaaagctctcagttaataactgtggaagtgctcataagaacactgaaagctgagaagcaggctctgtagcacttgggatgtaatgccagaaagaaaataagacgatttttttttgaaaaccaatcataactaagagaacaaagctgccaaaaacacaacaagtcaacctattatgcaagcgcgtgcaccaagaatgctttccttttcgctaccatccatttgtcacgaactattgtgttgtatctttcttgtggttacctacctatcatctattttgttcgtggtttgtgaaatgatcggaactattgtttagcagtcttgaccatcgatatcagcgttatcaacaccttttaggttgcggcttatttttcgaaagttctcaaaactaatagtagagtgtgctcttttgaactcaaatcacattgaaatgaaaccatgatcgccaaaaatgaatagattttgaagtggcgcaatcgacttgaaattgaactttaaagttagaaaatcacttcagtgaggatttcataaatttttgatttttctaccaaatgttattctattagcataattttcttcgtaataaaatttaaaaaatgtagagcagaatcctcacagcattctatttggaatcctctcaggattagcttcagaatgctctcaggattattttcagaatcctttcttcagaaaccactcaggattctcttcagaatcctctaatgattatctcctgattcctctcagaattatcttctgactctcaggattatcatcagaatcctttcaggattttcattagaatcctctcaggatgctcctcagaagcttctcaggattatcatctgaaccctctcaggattccctttggaatttcctctggactcttttgagaatcctctcaggattctcttcggaatcatctcaggattctttccagaatcatcataggattctgatcagaatacccttagagttctcttcagaatttactcagaattctcttcagaatccattgaggattctctttagaatcctctcaggattctattcagaatcctcatacgattctcttcaatatctcaggattctttttaaatgcctcttagtattctcttcagaagcttttctggagtctctttagaattctctaagggttctcttcggaatcctcttttaattttcttcagaatttactaaggatcttcttcagaatcctctcaggattctcatcagaagcctcttagttttctcttcagaatcctctatggattctcttaggaaacctcttaggattctcttcagaaccctctcaggattctcttcagaatcctctcaggattctcttcagaatcctctcaggattctcttcacaatcctctcaggattctcttcagaatcctctcagaattctcttcagaatcctctcaggattctcttcagaactctctcaggattctcttcagaatcctctcaggattctcttcagaatcctctcaggattctcatcagaaccctctcaggactctcttcagattccttttaggtttcttttcagaatcctcttatggattctcttcaaaatcctcttagaattatcttcagaatcctttctgatttatcttcagaatcctttctgaattctctccagaatcctctcaggtttcttttcagattcctctcaggattctcttcagaatcctctcaggattcccttcacaatactctcaggattctattcagaatcctctcaggattctcttcataatcctctcaggattctcttcataatcctctcagggttttcttcagaatcctcttagggttttcttcagaatcctcttatggtactcttcagaatcctcttagggttctcttcaaaatcctctcaggattcagaatattctcagtattatattcagaatcctctcaggattctcttcagaatcctctcagggttttcttcagaattctcttaggactctcttcagaatcctcttagaattctcctcagaatcctcttaggattctcttcagaatcctcttagggttctcatcagaatcctcacaggattctattcagaattctctcatgattgtcttcagaatcccctcagaattctctttggaatcctctcaggatttttcttcgaatcttcttagaattctctttaaaatcctctcaggattctcttcggaatccttttaggattctcttcagaaccctctcagaattttctcaagaatcttctcaggatgcttttcagaatcctcttaggattcttttcagaatcctcttagaattctcaggatgcttttcagaatcctcttaggattcttttcagaatcctcttagaattctcttcagaacccttcctgcattctctccagaatcatctcaggattctctttagaattctctcaggaatctcttcagaatcctcttaggattctcttcagaatccttttagaattctctacagaatcatcacaggactgttttcagaatcctctcaggattttcttcagaattctctcaggaatctcttcagtatcctctcacgattctcttcagaatcgttttaggattctcttcagaatcctcacaggaatctattcagaatcctcacaggaatctattcagaatcctcacaggaatctaatcagaatcctcacaggaatctattcagaatcctcttaggattctctttagaatcctctcaggattctcttcagaatcctctcaggaattctcttaagcaatggcggtagaaacatcaaaatggatttgaaaaagaaaaatattccctaaacctcaatattcgcagttcaaaacaacttcaaaagttttattgtaaatttaatttagaaaagtacacaatgttttggttcactaatttttaaaaaaataaaccgcacctcaatacccttaccctcatcattcatatctatttgattcattactttaagtatcgtttcgtgacattgacattttattacgtactccctgcttttcctctttttcttctttgtttcgcactgtttatgaaaactgacacttgctccatcaaatggtttcgctaagtttactacaatttcaagacaacgcactcgctccagtatgtgagcaatgtgctcatattctgttttgtattttgcacgatctcagcacagaacgcatcctccatctttttttgttttgcaaaacaaaatacttctcgatgaccttgttgcattaccccaaagaccctcgattcctatccagaagttcaaacaaatcaatacaaagttgcacttctgcatcgtttcttaaactccccgcactttttgctgtgacttccttcacatttctcaaaccttgtttcgttcatatcatttcgactttcttctcgattcgaaccctttttgttgatgcatgtttttttctttctttttttgtgtttctcttcttttggtatctctcgaacgacaacaacaaataccggcatgtttaggcaaactcgccggagattcaaccgctggacgatgcgattgtgtcgctgctccgggaacactcggagaacggaacggtaagtaggattgagcgctgtgggcagaggcgaggagcctctggtgggggatgggggaagtgtttttcatggaaatgtgttggtattatgttgcccttctagtacttgttgttttcaatgtctattgtttaaccactcatgttgcaagatggattgagaataaccatcataataaaaaaaatcatccagttctttgatgaatttcttgaaagattctcaacggaattctcctgagatgttcaaatagtaatagtcacctacaacttatgccctatatgcttgtcagatttctttagcactaattttagctccagatctttgggaaactctcgcaagatttttttccaagatatattgcaactttggctgttttctcttacggtcctttatttaattgtcttgcaagaatatttttttaattttagaggttctattagcacgtattacaacttgcaagctcataattaataatcattcaaccagcaacagtatgcaattctggataatcaacacaaatttaatgtcaatttctataccgtggcatataaaaccacatttattcgattaaaaaaaccaatccctatcatgaaaaaatcgaaaagtcaaccaaaaaacaacactctttcagaaaattcaaactattggtgtcaacattggggcattctaggtacatcttagtattttttttggatttagtgcagtagcttcggtgtttggttctgtctgaagtttccattatacatatatttaacaattatattgtgatacataaacgcaaatttgaagggtattttcattaggtgaaatgtattattagggtggttcaaaatttaaaaatgattgagattccaatctcccatatgctccttaccattcttaccataaaaatagtgttctttaaaattttcagctttctaggtagagatttaaaggtggcccatagacaatgtaagtgtatatggaaattactatggagaaattttgagatatgttccaaacacgataatactgtaatgtaactataagcttattagcccatagtagaaactcatttttcaaaccataataaataaacttgctgaagagagaaaatcaaaccgacggatagcaaaagagatattcaagagtttgtttgctattatttagcttaatatgtgattaaagccctgcaaacatgtacaaaaatcccaaacataattagctcaaaatggatttgtttcttcaccaacatccttcattaaggtttgaagaattagttttcaatatgggatgataagtttctacttacattacagtactagcgtgtttggaacatttttcaaaatttctccatagtacctacattgtctttgggccacttttaaataaccacctagaaaactgagaattacacagaacactatttttatggtaaggatggtaaggagcatatgggagatcagatttcttatcgaaatcctctcaggattctcatcagtatcccctcaggattctcataggaattctctcaggattatcaacagtatcctctcaggattctcatcagaatcctctcaggatttttatcagtcttaaatctaaatcctctcaggtttctcatcggaatcctctgaggatttttatcagaatcttctcagaaatctcatcagaatgcttcagaatactgaaaggattctgatgagaatcctgagaggattaccatgagaatcctgagaggattctgataagaatcctaagaggatactgatgattaccctaagaagattctcatcagaatcctttcaagattctcatcagaatcctctcaggatttttataagattttgatcaaaacgttctcagaatttcaattcatctggttcctcatcggtatcctctgagtattatcatcagaatcctctcaggattctcatcagaaacctcgcaagattctcatcagaatcctcttaggattctcatcagaatcttcttaggagactcatcagaatcctctcaggattctcatcagtatcctctcaggattcttaacagaatcctctcaggattctccagaatcctctcaggattctcgtccgaatcctctctggactctcatcagaattttctcaggattctcatcagaatcctatcaggatttttttcagattctaatcgaaatcctctcagatttcttttcgtaatcctcacaggattaacattagtatcctttctggattttcatcagttccttctcaggattatcatcagtatcctctcaaggtttttggcaaatttctgcatacagaatctgtatatctgtatttttctaaaaaatctgtaatatgtatatacaggttcttggtcataaaatattcgagaaaatctgtaaaatacagataaatatgttcttcttagggttctcatcagagtccttacagaattctcattgtaatcctctcagaattttcatcagaatcctctcaggattctcattgaaatcctctcaggattatcaacagaatcctctcaggtcttttataagattataatcaaaaccctctcagaacttcaattagaatcctctctggttttttcatcggtatcctctaagtattctcatcagtatcctctcaggattcttatcagaaacctcgcaggatcctcatcaaaatcctcgcaggattctcatcagaatcctctgaggattctcatcagaagcctctcaggattatcatcagaatcctttcaggatagtgatcagtatcctctcagtattctcattagtatcctctcaggattctcatcagaaatctctcaggattatcatcagaatcctctcaagattctcgtcgaaatcctctcaggattctcatcagaaatctctcagaattatcatcagaatcctctcaggattctcgtcgtaatcctcttaggattctcatcagaaacctcttaggacaatcttcagaaatctctcaaggattcttatcagattctgatcgaaatcctttcagattttttatcggaatcatctcaggattctcatcagaatcctctcaggattctcatcagaatactctcagtattctactcagattgtaatctgaatcctctcaagattctcgtcgaaatcctctcaggattctcatcagaaatctctcagaattatcatcagaatcctctcaggattctcgtcgtaatcctcttaggattctcatcagaaacctcttaggacaatcttcagaaatctctcaaggattcttaccagattctgatcgaaatcctttcagattttttatcggaatcatctcaggattctcatcagaatcctctcaggattctcatcagaatactctcagtattctaatcagattgtaatctgaatcctctcagatttctaattggaatcctctcaggatgattatcactatcctctcaagattctcatcagcattagaactttagctgactgcttacgagttctcattcgagatcttatgtggactccagagaataaagaaacttttactgagttggactttcgaagaaacttccgacagttcatactttctagctcactggtccattccgtaacaagttcttgactctaccttacttcatgttgccactagttcgtgaatgaaaaagggatccgacctaaaaaccaagatggtcgttttgatttgcttctgcaatcacaagctacggaaaaacccctggccgggagtagcgatatttttgattttggttttcttgttcaagtttcggtcaaggttggttcactcaccttattcctggaagcagtttccattgccaatttgttttagacttttagagaatattttgtgatttcctccaggggtccagaagctccttcgaagagccttgtagaagatcgctcctgtagaagttcatcatgtattcaagcagaaatttcatcagtgaatttggtagaattttttttaggaattcctgaataaattcttcgagaaaaattttaggaatgaaatgtaaaagaattcctgaagacatcttggaaagaatctgtggagtagtttctggatgtttaaaaaaaaatacaaatcgagcccgaaaattttagatgaaatccaaatagattcctagaggaatctcttgaataattcttaaagatatcattagcaatttttgaagacatcttaaatgagaaatgcttgaaaattctctgaacgcatcttcggatgaattcctgattaaattcctttaagcttttgatccacactttaaatgaaaatgtgagttttgtaaaaatacggttttgatttgtattttgccgtataacgccgtgatgctagtgctacttcctcttcttcttgacattacgtcctcactgggactgagcctgcttctcagcttagtgttcttatgagcacttccacagttattaactgagagctttctttgccaaagttgccattttcgcattcgtataacgtgtggcaagtacaatggtactctttgcccagggaagtcaaggaaatttccataacgaaaagatcctggaccgaccgggattcgaacccagacaccttcagcatggctttgctttatagccgcggagtctaagctaaggaaggccccctagtgctactataggaccagaaattaaaaatagtgctactataggcacatgtgttcctttggtggcataagcgataattaatacatacatatgagttttcgtagttttcatatttttccttcaaaaccaagataaaaagctttcagatgatgtaaaagtatttttcgatttcatacgaatatttgttcttagatatgtggctattggtacatcgaccctaatcaaactttagtacaaacaattataaaagtatgaatgatttaaaacttaaacttggttttgtaaatgttacttttttgtgttaatgcactgcactttgcttcctatcatatttaatggtaccgtttatcactaaaactccccttattccccttcatatcttaccaatttccttcatctctgttcttttccactcactcattccagggcacccgcatggaggaacgcttggacgacgccatcaacatcctgcggaatcactgcgaaccgcaggtcggtgtgtcgctctcttcgatcgatgccggttcgccgtacggtccggccggggcctcgatcattccacctggcacttccggcggtggttcctcctcatcacagctgcacggccaagactcgaccagtgatctaccagtgacggcggcggcggccgtggcagccggcctagtaccagtgaaaaccgaaagattacccagcacaccggtcgcgatgaacagtagtaagttttgggggtggttgtggcagttgagttgaagtttactgacgtgtctcactcttgtattgcagagaaacgcaaagaaccgccagattcagataccaaacccagcagttccgtaccaggttccaccaagggtgccaagcggcagcgtaaatagtgagtgatgttgtaatttattctcagccatactcatgcatttgattaatttgatttagattatctgtgtttgatatagttatagtattttcctaagttacatccagtaatgtattgtttttcgatttcttgcgttttcttttcatttcgaatcaatcttctgtttggttggcgttgttttatcctgatttgtgtttgccactaaagtaaaaattcacgtagttgttccagtgctgacgatgacgacgacgacgatgatatcgatcccctgacgaaggatcgaaaggagaaggaacgaagacaggccaacaatgcccgcgaaaggtttgatattgctattattgggggcacaaattgagtgatggttctaacaaagttttcaatttcattctagaatacgtatccgggatatcaacgaagcactgaaagaactgggccgcatgtgcatgtcgcatctaaagtccgacaaaccacaaaccaaactcggcatactgaacatggccgtggaggtgatcatgacgctcgaacagcaagttcggggtaagtttcggagaagataagtggcggagtatacttcgaattcgaatgttcatgagattatttcattcgtatgccgtagcgttctcccagtaaacagatcgccatgatgtctctagagataaattctgtaattgggacaaattttgtgtcactgttcgcaagtatttctgttctaggtttgaactgactgccattgtatagaactatacaatttttgaagggcagccaagaaccctaccattatttacccagggctcttgaattgttcccatatctatattttcttccgtaaatcttctactaagcactgctgaagcacccttcgcatgataaaggttcacctgaataatgttcatgaggttcctattgaacatttatttgatttatcatgtaaaacttaccttctcattaagggcactctattcccgttgctgaaggcactgaactaacgagttttgattgatcgtacagggcttaccaaatttaggttggcagcattgtctgcataccgaggggcatatcaatagtgaaaattacatacactggacgtaaattgcactctcaataatcgagaccgcgaaggatcgctttggaaggcttgtcggcctcgatgtcgtaggtgaaggtgaagaataattggatgttcttcatccccaggtacgatcccatcgcacggatgtgcttgattgacggaacgatgattttgtagccgtccgtgcaccgacggaggggtgccttcagccttgtttgacatagtaattttttgacgcaggcatttaattgcttacggtcgagatcaccctttatttgtagaaaagaaacttccgcgagtaactacgaactttgttactgactgtaattcaagatgtagaacattcaatgaattaaatatcagaaacgttcacttttcattaaaagcaaccgctctgtatactgataaaaatccacacgttcgatccgtgtgtttaaaattatggatcgattcataaacgtctatatcgatttgctgtgattttcttacaaacttcgtgtgtgctacacattcaattctttagttttgctccatggactgattaatcaagcgacaacatgaattccatagttttccacatatgttcctaaaactttccttttcaaattcgtgtgcgtcaacctatgggtgcatagatcatcacccaacacggattcagtgtgtttaatttatggctatcttgtgtcatgatcattatgttcaagttggccgatttgaaatcgatgagcttgctgtcgattttcgtgttccaaatttctaaattgttagtgatcaacccatagcgaactgaattgcagtcggacctcgtgtcgaacgacagtcatcatgttccaaaaggaagaagcaaattctgaagctgaaagtgttagagggaaatttgcggattcgattttctttctcttagggccgatttcttcaccttcgcttaagccgtaaaccacgtttacccatacgattaaaccaggtttaaggcctaagcggtggtgaagaaaccgcttattagtgaagatgtccgagtgaaggtgaagagtactttctagttttctgtaaataaaatgcattacttccagcattccatatgatgtatggtgttagagaaaaatcggattccactaacagattttcctagctttcagcttcgaataaaatgaaatatgtgtctcccgggcttcccaaattatggatttgcggctccccgcttgttgctgactcacttgtttgaaaaaaaaaaaaacattcaagtgagctttcgacaagcagaggagcctcgaatccatattttggggagcaagagttcttctatcaaatttattctttcagtctcatgacattaatgttctatcacacatgactaccgaaagccactacaattcgaattcaataagcaaatgagatggttttcatgatttaatatttaggcattcatggttgtttcacatgacaacctaatgttgatcatgttattatcagtgccgtagcgtgcggttggccaggttggcccccgccaagggcgctagccttcagggggcgccaaaatgagagacgcatttggaaaaactttaaagaaaacatatcaagtaagggcgccttttcacaatttcacagatatacgtagacataatggtataaaattgtagtaatgcctgaatcgcttttaaaattttttgataaaagcttctcagaaaataaatacatagaaggatagtaaattgaagattcctaagagaaaagcttggaattatcgttaaacaatcattggacattttcttacgcctgttttactaaatagaaaatacaacaaactataagtttattgcttttttgttcatttcaattaaactggaagaaaagttgcagcattacagctaaatttgtcaaacacagcttgattcagttccaggatacattccaacaaaatcccgataaatattttttttttatagaatctagggtactaatttaatactatcttagaaacgtttcaaacagaattctgagccaaaatttcaaagtatattggatatagctgttctaaactttttaatagtaatctaacataattctaacctaaaataggattctcacaatacctttggcaggtttatgatcggatctttaacaggtttccatagaatttcacataggatttacatgtgatcgaggtgtaggaaatcttggccaggattttcacataatccttggtgtcattttgaaaaaaaaaggtggaaataattctgaacaatattctttgaaaatttggttggcatactcataagtgctacacataattatcaaaaatcttaatgaagattctgatggaacccttgagacacttctcacaaaatcgtgatcagaattctcaaaaatgtttgtgtttttttaactattttgaaagacaacaaacaaacaaattcccctttcattcttcttgaaacatattcataacgcaactaattatttttaactaaccctttcaactactttgataaatttacttatgctataatagagtcctaaagccctgtaccaattttagtgccaaacgcttaagtttaggctaaaaacacatgtttactcaattttttgatgtttttcgtttgtttaagcccaaaaaacattttttcagattttgtcacattccttggcttaaacttaaattttgggtatattttgctttccgtgtcccttccaaaatgtcagataggaacaaccccggtgttaaaactgaaagccctgtggtgtttttgtcgattaagagaacgtcaaacatgatcacaagtgtcaaggttcatttatggtcccaatttttaaaataaagttttaatatgatatagccgttatttgagcgggaaaaattgctaaaataattgcagtaataagctctttcgtgtcattaaataaaaacaagatttcattaagcattttaggacccaattggatgttttttaagaaactgtaatacaaatattaattatttgagaatgactaaaggcctctttttatgaaaattattttttgctgagaattgtattgtaaaggatcaaatggtaattaatttttaaagttttggacgaacagtcttagataatttcacaaacataaataattcaacaatgttttgaagaatttccttctcgttaaatggaacacttcctgatccttcaaacaagggatgttgtttctgatcatatcagcagtttatcataaatatatgtagaaaaaacattttaagaatattcattaatattcatactgttttcctaaacaataaatatagcctcttgcagaagttccaccaacagtttaatgtcttctaaatttaagttaattcttaggtttaatcataatcctctggaggatttgtgtgatgaattcttaataatgtagccatagagttttgaatttatccagggtcgtacaattggaggttcgccaagggcgccatgaagtatcgctacggctctggttattataccgtgaagtcaatgatggatttcatatggctaccacactcaagtcaagggatggtacacaaattatgtcacgctaaatttcgatttttttgaccacctccccccccccctttttgtcacgttttttttgtatgagtccttcgaaaatttgtaaggcttgtcacgcttggcttcaccccccccttggagcgtgacgtaatatgtgcatgacccccaagtggttttccttattgtgcaaatctataagtaaaacacacgaccttgacgtgcagatttttcttagtgtatatgattttatacagtgctcgttcgattttggcacggtacgttttaggcaacatgaaaattgttggtatgttgccaaattcgaactggaacacacttatcatctttatggttttatattcaatatcttaattgctagttctaggaacattggaataattcacattgtattccagacactaatttcaaactttcttccacagaacgcaatctgaacccaaaagccgcctgcttaaagcggcgagaggaggaaaaagccgaagacggccccaaactgccccctcacatactacaccaaacgccgtacccctcactacccgtaagtaacctcaagcaagaacgagagtgagagcactgagaacgcgcgtgtcgtgccgtggcatctataactagcaaaaaataatgaacaaaatcgcaatcggtacttcaaaattcaaacccatacccgcttaattcggctgatgtatgtgagcgaaacaatcgaaagttatcgtacgccaaatgatcgagcgtgtatgatgatacaacctatacccctagtaaaacagcacgagctaaaattgcactctttttcttctctaatttcttccaaaccaacaaacaatcaatctgctatctgtgtgtaatgcgtgcgaccctctgaataccacccacacaacaacaacaacaaccactccgacaacaactggctattggttcaacccaaaaccgtgatcaatgatatcaattgtgtgtatgcatttcaaccatcccaactatcactacgaccaccaccaacaacctacaactacaaccaacaatgaacatgaacaattccgtgtctcccgttgatctaatccggttccgcgtttgtgtgcgtgtgagtgcagggcccgccgccaaatcttccccacaaccccgggccaccacaatagcataataactttaataaccttattcgaagataacactgcaagcagcatacatgtacatatactagagcagcgggaaccgttgcaacagccgcagccaccgcagcttcttcagcagtagaagaagcaacagcagcagcagtgacaaaatcaacagtagtgggtgaatcgtgtgagtgctggacgggtgccgattggtggatgtggttgtaagcgggaagagtgattgaatgggtgatcagaatgtgaggaaggtttgtgacactgatctggaaatgggaacgaaatattgcgctatccttttaagtagctgtctgtattgtcaatcggaacgagtaacggattttagaggagaggtagatcgaacgattcgggaggttaaggaattgatcggggagatcgggaacagactagaattggagaaacatacgccgcgaacccttcctcgtcatgagttcagtaaaacaactagagagtgctaggtattgaaagttagagaagcttatttttattgttaatgaaggaattataacatcacatcgatcagactgtgtttcacatgtaggagtttcaactttttcaaaaaatttcgaattggacaactgggggttaagcagtgtcgttttttttaacgggaatagggattattttcgtgaactcgtgtgaaccaaaaagaagaataaggtttgccaaacataatggactaaatggaatgagatactggaattttgatctgcttggaatgttcaattatcaatgtaatcaaatgtttcaaacacatcaaagttcgtcattgatatacagtctcttcaaaatcaatatctcctcaaattactgtatatgcctaagtgatcctgtcatggaacgagtcccaaggttccaaagtccttatgagtttttacgaagggtttaaagaactcctcgatgcttgatggacgaataacccatccgttgattgtctttccaacaatattctcccttcacctacttttactttccgtacagtcagttttctttcagtccatgtattgacaaattatgtgttgtcaattacacaacaattcatttccgtgttacacgttgttggcgcacattccagcgtttgtgaggtcagtgccgtgaaatggccagctgacgacgaacttttcttccggacttt

SEQ ID NO: 162 - DNA, 8231 bp, Aedes aegypti
ggccaagtcatccaaaatgtttgaacaatatttattctcgatttgctaaataaatcatgaccgcggatccaaaaaacgagaagaattatgcgatccaccctgaaaattttacggaaactcgttgataggcggaaaggggttttgaaacaagagactgtcattaatttcataagagacaataataaaaatgacgataatggccaaataataaaacaaaacaattttgaaaatattgaaaatgataacaaagggaggtaacaaaaaatcaaacgaattatctgtttgactttgaacttaggtgcataaaaggctcgctaccgtgctttctttcttcgtgcgtaagtttttgattcatacggcaggtaactgctctttgaaatataataacacatttctacccagcatgaagtgtgagtcagccgttggagtgataggtacgatcgagaaaacaaacatttaagcttacctccctgcgagaaggttcagttcattcgaaacttcccactaaatcgtttcgttcaatcaatgtgcccttcaactattgccacctttacagaagtcattacttattgtgagtcacgcctattctaattcgtcccgatgaccgttgttccgtatcccacagctaatgccaatgcaagaggcagcagcagtcgagtgcaatcgcaagcatcggatcgacgtcgtcgtattcatacagtgtcattagtggaaccagctggccggccaacctattcgagtaggaccttagtgaacaaatccggtaggaccatgtggaacgccagcaacggcggcggaggagggggaggtggcggcggttcctcctccagcaccaatccgacccagtccaataccagaacgcttggaatgacttcggccatcagtttggccgagccgaaaccggaggacattcagaagacgacggaactggagaaagccctcgaaccgtacaatgtgttcgaggaagaatccgagctgaaccatcgaatggagattctggcaaagttaaataccctggtcaaacagtgggtacgtgatgtgtccatttcgaagaatatgccggaagccctggcggagaagctgggcggaaagatctacacattcggttcgtatcggttgggggtgcatcacaagggggcggatattgacgccctgtgtgtggctccgcggaacatcgaacgggcggactatttcgggtcgttctttgagctgctgaagaagcaaccggaagtgaccgagtgccgcgccgtggaggaagcgtttgtacctgtcatcaagatgaatttcgatgggatcgaaatcgatttgctgtttgcgcggctggcgctcaaggagatcccggacaacttcgacctgcgggatgataaactgctgaagaacctggacccgaagtcggtgcgcagtctgaacgggtgtcgcgtcacggacgaaatactgcggctggttcccaacatcgacaacttccggttggccctgcgggcgatcaaactgtgggccaagagtgagtatactgatattctttttttgttacgatttataatgaaaattattctctcttcacagaacacggaatctactccaactcgctgggatattttggtggcgtatcgtgggccatgttggtcgccagaacctgtcagttgtacccgaatgcggtagctgccacgttggtgcacaaatttttcctagtattctcccggtggaagtggccccagccggtgctcctaaaacaacccgacaccgtcaatctgggcttccaggtgtgggatccgcgggtcaacgtccaggatcggttccacctgatgccgatcattacgccggcatatccccagcagaactccaccttcaacgtgtccagctcgacgcggaaggtcatgctgaacgagttcaaccgcggtatgcagattaccgacgaaattatgctaagtaaggccggctgggacaagctcttcgaggcgccgagtttcttcttcaagtatcggcactttatcgtgctgctggtgacgtcgaacaatgccgacgatcacctggagtggtgcggcctggtcgagtccaagatccggtatctgattctgaacttggaacggaatcagcacattaatttggctcacgtcaaccccaagtgcttcgagcagcacgaacagaaccaaacggaacgacagcgagaaagcgacggaagccgagctagtacgctctgctcgctgtggttcatcgggttggagttcgagcggtcggagaatctgaacgtggatctgacggagagcatacagagctttaccgactcagtgcacaaacatgctgtaagtatcatgatttcagagctagtagcaagtctagttttagaccattccaatgcatgtctctaattattgatggatggtccctattttaaccaacaaggtatataaagtcaccatttttcttattatgcctgttatgaaacctggtagaaacatcttcaaatgattactccagagatgtcttctgaaagcttccaggaattcttccaaagattcctccaaaaattcctctagagaattctagaaattattcataaagttttcaaggaattctaaggattttctccagaatttgcttcaggaaatacttgagcacttcaacttggttttcacattttacttgtagtgaatccagatgcaaacattttctaacaatctctctagggatttcttctggaatactttcaggtactctttgaggaatcccttcagaaattcttttagagattcctccatcaattctcctaaaaattcctcttgcggtttccatggcattctaaaaggaatgtataaagaatttgctcctagaaatacttgagctcttcaaaactgttagacccagtaatttccacagagattgctctagaaattgccccataaactatatttttccattaattctagccctttgatttctatctggtgtgctaattcatttccccccttttctcaatccctttcccaggtgcacatcaaactgctgaaggacggcatgaaaatcgaagcgcggcacgtccgacggaagcagctcagccaatacctggatccgaacctgctcaagcgggagcgtaaaaattccgactcgggtctttcgatttccagcatagcggctgtggcggcggcagcggcggccaataccagtggcggcggcggcggtggtggcaccaccctccggaagcggcactcgtccgaacacctccaggcgacggtcaacaagaaaggacggaacgattctgtgagtgattcgtaatccctcgtacctactgcttatattttcctatattctatcgtaataccaatttccgtcggaactgttcctgttagttcaaattcggtgcatgtttttccttaatcggttctggagtatcgtgacggcgaggttttccatcagggctggtagcaagtctcttattagggacttggtcacttttttaatgcaagttccttataaatctatattttgaataaaaagtttctataatctattttaaccaaaatggtctctaaagtcacttttccttctaattgcaatgaattccagtggaagttcaatatgctcaaggagagaccttcagagactgttcaacaggttcttcaggagttttttcctcagatttctcgagaaaaaaaacagaatttcttcgaggggtttgtcctgagatttgttctggaatactttcaggaacatttctagcgatctcatcagaaattccactaccaattgttccagcgatttttgaaaagaagctaggaggaattttcactaattttacgaccgatttctcaatttgtaactctaggagattattattattagctttattagggagattttcagcccagggctggttcatctccaactctaggagatctttcaaataaacgagcttttctaaacaagatacacaaatgtttatttctgagttttcaaagaaactcgttaagggatttttcaaagaaacccaagaagacttccttttttctattttttttacgttaatcttccaggcattttttcgagaatttatcaacggttactcccaaaaaaagctccaaaaattcatccattagtttgttgttgaggaattagttgaggaactttatgagaaacacttccgggaattccgcaataaattcgacctgggattcctcattcctcgaataacttctaaagtgaaaactcgatgaaacctatcaaattttccaccagtttatactaaaacagatattccagtagtttattccatcaaacatgttcaaaatttcttcaggggttccgtccgatgcttctcaaaaaaatccttttgaaaatcataccggataatatccagacattcgaatgatttcctttttcatttttttgcaatttatctaaaagattgtctatggtttcttcaagtatccaagagttctgtcagggttcatcaaaggttactttggaatttggataggcttcagagattactttcggtttttgtttagaaggacctccaggattccttaaagaatcaaataatttcagaaaaaaatacctggaaaacaattttgaagacgtctttgggaaattttccaaagaatttctggaagattcctttaatgtacagtattggacaacacatttgcaactttttcaattttccatacaaaatcatcaagtttcgtctggaagaatcttttttacgttattctttttcttggcattaacgtcctcactgggacactgggactgcttctcagctttgtgtgcttatgagcacctccacagttattaactgagagctttctttgccaaagttgccattttcgcattcgtatatcgtgtggcaggtacgatgataccctatgcacagagatgtcaagaaaatttccattacgaaaagatcctggaccgaccgggaatcgaacccagacaccttcagcgtggctttgcttggttgaccactcgactacttccagccattttgtcgagaattcatttatgattacccccagtaattgctcgattgattcatccaatttttcgaggaattttatgagcaacacttccaggagttccgaaaaaatcgatttgggatttctcatgaagtaccttttgaaatttctttatgaatttttccagcattttatccaaggatgactcctgcaaatcttccaaacatttctcgaattacttctcaattaaagtatcaatgaaactttctaaatttcacatcagttcatactaaaactaatattttagtaattcattccatcaatcatacacaaatttcttcagggatcgcgttcaatgtttctcaaaaaatcgattcgacattcgattgattttcaattgtctttgcaatgtattcaggggaccctctactgtttcaagtgtccagaagtcatttgagggatcctagtaacgaacgttactttagaatatatgtatacaagtttcatcagagtaacttttatcatccaattaaagaacaaataaattcgagataagtctcttttgacaccaacccgaaaaaatgcaatcttagagcgctagagcttttgtcgggctaaattctattcctggcccagtgtgcactgtatactagttttttttacttattcatttatttagttggcttaagcgccgtcaggcatgacgcagccgaattcgtttgatttggtttactaaatattgtttatttcttaaacatctttgttagttaggactcagggttcctgattggccacttcccccagggcacctagaatctactatagagtgctcagtgtatctcattttttatgaatatgctcccggaatcgtcatcttgaagtttgatacccacttggatatggttccggataatatatacagtgaaacctccatgagtcgttgttccatgactcgatatcgactcatggaatcatactaaaatcaaaatttcatggttactatgatggtcccttcttaccgctttccgaagcatttctgttccattactctatatttccattagtcgttggttgcttgaaatatcgactcattgaggtttgactgtacatgattggaaatacaaacatgagtgaccgtatttccgaaaccagtttgacgaaaatggtcatatttcgaaaaatttccaacgaatcttattgcgtccgccggcatacaattctcaattgggtcctaaaatgtttaatgaaatcttgtttttattcaatgacacgaaagaccatgttactgcaactattttagcaatttttcccgctcaaataacggctacatcatatttaaactttaatttaaaaattgggtccataaatgaaccttgacacttttgttcatgtttgtcgttcgcttaatcgacaaaaacaccacagggcttttagttttaacactggggttgttcctatctgacatttcggaagggacacggaaagcaaaatacacccaaaatttgagtttaagccaaagagtgtgacaaaatctaaaaaaaaaaaaatttggacctaaacaaaagaaaaacattaaaaaattgagtaaacatgtgtttttggcctgaatgtaagcgtttggctctaaaattgggacaggcctttaggaccgaattggttcaagttgcaaagaaaaatgttcacttctatctatacatgtaatttgtgcatagccttggaaaatccgtaacatctccgttgtccggtggccaatatgcatggcaaggcaagttactgcaacaagaccaaatttactttgaatacaaatacaaagttttgcctatctcaatccttttgcatattccttgtacatacagtaaattatacgagaaatgataggtacttgttgtaatgtcacaaggaattccctagaaaaaaaaatgaaaaattctctgagaacgtctgataagattctatgagaaatcaaattcttatctcctatttgatgataggtttttttctgtttttgttattgctgtttagcctcttttttaggcaccaattttcaatacatttagtcgctatcagccctgtccgtcacattctaaaatcaattaaaattgtcctcgaataatttccaagtcagaactcatctaacccattttgccgtttgtgtttattcacaaaatctgtgtggttttctttttctctctttttgtctctccccatttttcttgcacaccgcgttacacgatctcatttcagtttgaacagtccccgtcgaacgcgtcttcgcagtcatcgtcgtcgtcctcgtcgcaatcctcacaaggagcgggttctgtgtctgcagcgaacaccaccaacacctcggtagtggcgtctgtgaacccaacaactaaccacaacgtgtccgctagtaacgaactccctaacagtaataacggcgccgcaccagacgtcgagacgtcttcctcggtggaaccttctacgacctcctataaccacacgacgaaccacaatgacacgaccaatacgacgaccctggtgctggacgattcctcgtccgaagcgaccagtggcatccagtcacaaacgaccgctccacagactccgacgacaccgacgccaacggccaatcctggaccaggaccacaacaacagccgccacagaccgctaccgaggtggtttgctcatgacagccgaatccgttccggaaggtgaacaactatcaccttcactatattagtagtagcaacagtaacaaccttagccaccatcaccacccccaccaccttcatcatccgaagcatcagttcccgcaaggcccgagttacaacaatggcatcaaccaccagtatccgcaccatcagtcgcttcactatgtccatgggcaggaacagcatcagcatcatcatctccacagcagcagcgacgagggcagctatggtgctaatcaggacagtggcgacccccaggtggtgctggtggacggagatgatgatgaggctggcgacggaagaggcggcaactattccaacgggaaccgggtgcagtatgctgaagttgaatgtaagttttcttaattatatttttttaggttatagtattctttaccgatgtacgagcaatgaatcgaaagatgcatttttcttaataaaaattgacttattataaaacgtaggtttttcttccattccccattttattccgagctagacaggacttcctgtcctgatggttgttgtggacaggatttgttctacactgaagtgccacctacagcttagagcttcttt

SEQ ID NO: 163 - DNA, 15949 bp, Aedes aegypti
tgtcttccaatgagagacatgtcttccaacttggcatccttgcatgaggctcctgcccctaagtctacagcacgtgcacaataactctacttacgaggtggtgagtagagtgagttggtgtccaaaatggccattcatggcgttatgaaattggtaaatagaccctaggatacggagctacttgggcacttccataattcgctttggcatgaggggtttttctcggccgaattgtctaaaactttgcaatcattgcaatacgacccacattggcccaaaaataagcacagctgtggactagtagctttcaaaaaaccccacagcccaagtgagtcaaaagtgccaagaataggatccggctccctaatttgccttgatgtggttgaggtaaacttaaaaaaaaactggaaaataattttcagaaaagatattcatgtagcatgaaacgattttttagcgtgtggaaaattaatcgattaaaaataatcgacatttagttacacacgccagcaaaataccacatggataaaaattgtaatcgtggcgtagttgctttaagttaccgaccgaaatcttgttcattaaaacgttagaatcttataagtatacgttttattcgactcaatatctcaaattatgacgtagcatgtggaagttcctgggagagattcaaatcgactttagaaagtatttcccttcatacatttttttagcgtattcgttgtaaatgatcgattttttgaaaacatttgacatgcctaaaatttacatgacatctctcacacgcacacaaacaaagtatgacaaggtacaaggtacgaccatcgaaaggtataatcgtttagaaatgtagaatataaaaatatggtagatgtgtgcttgcgaacagacttcgtaggttctgattaacaaagttattaaaacatatttttatgatattttgcattgtaacattgtatagctttgcagtacaaaatttatactgtttacaatttatacaaatattcgtcattatatagaaagtagcataccgctttttcaatgactttgatgatcccgtaactgtctaacggtaagtgacaccaccacaacaaagcagtgccaaaaatgtttccgtcgtgtgttggcggttgccggacgacagtccttcttttgacgcggtgttttcagcagcagcagcagtttcgctacggattaaaaacagcacgttttctccgtacggaaacctgtattggacgacagttccattcggcggcagcagcagtatccggatcttcattcgtcgtttgtgattaccggttcggcagtaagcgaagttacacatcagcaaacacgggaagttcttgcctcaagatgaccggagcagccaagaagtacacgaccgtcgaaaggggcgctccgaattccaccgactatcgagtgtttatcagtgagtaccattatccaatttacctttactgtttctttataattttgatgatgtgttccaaagttgcacattggacttggaattagagagaaaattttacaaactgcaggcggcaatttcgctatttacctgctctgctaatgccattcaaacggatgtagtaatattagttgcataacctcaacccattatgtgtcagtacacccaataattactaaattgtacatggtaatgaatgaccattagtagggagggagaactcgaattttcgattgtgtcatgaattcggtttagagtgagtttatctgttgaaacatgtagcagtttctaccctacatgattcaatatttgacttagcttgcgtgttcccccgtcttcggcgctgtgacatatacatacctcacgcgagaggtgacctttacgcggacctatcttatcatcgcgcgcgctcgctagaatacccctttcggtgaacgctctgcgttagttcttatcagttgaagagatctgagttgaacacttcctcggaagtggtaagtaaagataactcatttcttttgtctcccgctaagaacaccaccactcgacctattgccttgaaattcgaagacactttctggatacaggtaaaatcagtggtgtgtcgtactaagaagcacttcatgcactacgcaattaaagatttccaattaatgccaagtatgctgttccgctcaagaaaagtaaaaatttctgcggaagaaatggtcaagaaattttctacagtgagctccatttgaaatgacatttcttttcgactgcgtactgcgatcaaagaaaaatgctctttttgaccatttcttgcaagaaatttcccacgcatcgagatagacgtttacttttttttttgaagtgcatacttcgcttaataaaataaaaatatatattataattctcaatacaagcaagattcatatatgaattatgattatattgtataattattgtagaaaacttgaaactatttttcctcaaagcgtctttgcgagccaaatttctctccccttggttatgcgaccttgccgcgatgggagggcataatccattggcccatatgatggaaaccaaaggcgtaacctatagtggtggtatcacattttggcattttttgcttgaaaccgcgtcataattcatatggcatagacgcaataatatctcggatgtgatccaacggacattctgcgtcgttgatagaattgatgcccatttcgaatacttaatctattcgaagtggacctctggcgatttttctttgcaaaagtaagttttccgatagtaaatcccatacaaactttgaacggctggcgcgtaaatatagtttcaccgattgagctgaaattttgcacagttgttatgagacctaaatgcaatccgaaaagtggactggagcgagaatctaaattttgtcccacactaatgggtatttttcaaaaactaccacgtcacaatatcaataaaaaaacagggcaccatagcctagtccgtctgagtattggtcctggtagaggggaaacttggcaaaagccagaccaagggttcagccttgacaagttaggctgtcaggcagctccaactgaacaccatacagaaaaaaacatgaatacatacaccaactttttcgcacaaacacatgttttatcaagtgcttgttccgatagtttagcgtattaatcaggttgccatgtcagtgaccagttgttcccgtgaaataatgcatataatcgttcatccaactggctgtttgttaagataaaattatgtatgttcttttatctgacaaaagaatgaatatgtctacgcttggtgaagtagtttctcaaaacaaaaatcagagggggttgtgtacaagacacgaccgcatgacgttaactacgccaagtgattttctgcacttgaattttagtcgattgtcatagttgcagccttcctttagttcaaaatctaacataatttcgtgacgatcgcaacattttagattttcaattgacatactggccgtaagacgtagttaacgtcaaaagcctttttcgaagacattccaacgaaaatattttcggaacatgaatagattgtatatgtatattaacttgttcttacaaattataaaatagggcaatttttaaccattgtgatgaaatcatatattttttatgttaccttcacgatggctataaattgcgatgtcccaacttgggtagagcaggagttgtgtttgatccttcgaccttgacgtttgctcctgcgggggccggcgatgagggcaggatcaaacatgtcgcgcgtcggtcgagtgaaagtgaaaaagtggcgtgatcgcttagttgtgtttgatccttcgaccttgacgcttgctcctgcgggggccggcgatgagggcaggatcaaacatgtcgcgcgtcggtcgagtgaaagtgaaaaagtggcgtgatcgcttagttgtgtttgatccttcgaccttgatgcttgctcctgcgggggccggcgatgagggcaggatcaaacatgtcgcgcatcggtcgagtaaagtgaaaaagtgccgcgttcgataagttctttttgatctttcgacgttgacgcttgctccttggcagtgcgtcaagaaagcccgagcagtcgtcagttgttttccctctcgggacgcgcgcctattttctctgtgtgttttcatatagccgagcaaacgagtgaagctgaaagtggattgttgctgctcaaggatgacggatcaattggtgagctcgtttcatgctactatatctaatctataaaatatgtatgattgcacctttaataatttttaaacaaactatgaaatgttcgtcactgtgagtgtcgacataaactctgattcataaattatttacgtcaaattttttttactcaaaacacctttttccttttacttttatttttgtaattaaaaaaaaaactttgaatggttcgacactacgagtgtagacttgcgaaaggttcactttattcaacaaactttgataagttcgtcacctcaagtgtcggcataatttttctctacatagatattgttcacaccaaatagaaaattttatatttacatataagcatatttatagctcacaaataattatttatcatggtctaatcacttatcaaagtgaatcctgtgacccaacgatcctccccattaacaaacatccctcccagtaacctttgtggagatgcagaggcaaacacggtctccaaatagcaaaggttacacactaacattccttcccccaatcccacctgactgcaaggacgtggccggcgccgttattgaccatgtataaatagaggcactgaattatgcacactgaagaagattttggccaatcccagccgatcttctagttgattctttgtgcattttcactgacctcggtcaatcacggaatagcaaccattgatatgtgtagtcagtctaagctaagctaagctaagctataaaaaaatgctttgaatggtttggtctgtgctagaagtgtagatttgcaaaacgttcattttattcaaaaaactttgaatggttcgccactgtaagtgtcggcataagaatattatgtgatggtctagccaatcgatattttttttttcaatttgagtaaaatatcctgtaggaatgttgcttttagctatttgttcaacaaactttgaatggttcgtcacttcaagtaacggcattattttctcatacttgaaaatttttcatgtcaatcgaaaatattatatttctaagtatgtttatatctcacaaataatcgtttatcatggtctaatcgcttatcaaagtgaatcctgtgacccaacgatcctccccattaacaaacatccctcccagtaacctttgcggagatgcagaggcaaacacggtctccaaatagcaaaggttacacactaacattccttcccccaatcccacctgactgcaaggacgtggccggcgccgttattgaccctgtataaatagaggcactgaattatgcacactgaagaagattatggccaatcccagccgaacttctagttgattctttgtgcattttcactgacttcggtcaatcacggaatagcaaccattgatatgtgtagtcagtctaagctaagctagctaagctaccttcacgatggctataaattgccctatgtcacattctatttgcttcgtgaatatcaatatcagtctaaagaccacactagcagctgatggttctggaaatgcttcctgaagcacacccttaaaaaatcgtgaagtttgcaaattggtttcttccactagggcaccagaaacctaccatagaataatcagtgcatttgaaggttctgaacatgctccctcttcttgaagtttaatgttcagttggatatgtttctggataatatatgcatgattggattttgaaatacaaacatcgctaaccatattataccagaaccagtattacggaaatggcaatattaaagaagatttcgttcgactcctaatgagtccactggcatttaattttcatttggttcaagtttcaatcaaaatcgttaacatcaatacaactttacaccgtacaaaaatacaagcgacagaagaactgtgattcagacaagaactcggaaaacccggatcatgtatggtgtccggtagtcaatatgtatggccactagcactttaattgaaattgctgctgagaaatacatagtgggacagatatgcgtagaatttcatcaatgggacaaatggacttggtacataccaatgctatgcttttcacaaaatcttcgaactaagtatattttatgaaactgttttctaaaaatataacgtaaaatggactatttggatactaaaacttcaaaatgacagtaagtaacatgggacaacataagtaacatgtaaacaaaaaaaaaattcttgggttttcttctgttcagttatgtttgttcaaatgattcgacaaccttataactgcaacatttccaatgttagttcttacactatggacagcaattgcatttctgctctgtagaatttccaccgttccttatttgtttttaagtatcgggagaaatcaaaaggaatccttcaataaagtatttagaatcatttttatgtggatagacatataccccatttttatgttttgaactagctttacatagacatttcacgagatttccgtgcgttttcttatattagaacttttcaatcaaagtcttccttttaattggttgtccgaagtagacatattaatatcgtcatttttctcaacctcttttagagaagttccatgatttctaacagcttttaacgctttgagtatagtgtttcttgaattatcagcacgttctgtttttcaatgataattgcgaaccttgttttcttatagctacctaaagatacaacacaaattcaatctctaatgagaaacttttacttgccccacgtgatttaaaaattggcggtgtatcaatttagttatttttatgtctacatagaattaattctaaaacttttttcattgcagtttgagacagttagaagggacaacttagaaatggtacagaaaataattttcctcaactttttttccactgaaaatattaaaataagattgcacgccgccgacttgtgacggagtgatagttgacaatctttcgctatattatgcaataatggctgaaaaatctcgggaatcttttacctatcataatgttctaaatggcctcactgcttacgcatgagtttaaaacgttcacatattcagtaaaatacaccaattattttcacttaccccatttacccacttgccccgcggtaccttagtattgtgacgtggcagtttttgaaaaatactcatattcccttgcttctgagaacagtaagcattgtgaaaatcagcaactctaacatactttgttcgaaatagtcgtgtcattactaggtaatactgtccaagtactcttaaatatactgtcgtttacgtgtcctttttagtaatgccattgtgactactcatgtcatttacgtgagattagagtcttaattgacgattaagtctgtacaaaattagtaccctgctcaaaaactaaagaatatacatcgctgaaaatttaagggtttacgtaaaattttctgaagtttctaggaaaaatgagaaaagtaataccctctttggtcccagaaccgagaaaaacaaaaaactaaaaaaaaagcctaaaaaactagaaatttttatatttcttcatgcaaactttttttttctgaaaagttgaaatcttaaacttttattccatgaaaaagattgaaaatcggttgagctgttcaaaagttatgattttttttaaataaaaaaaatctaatgcgctgaaacctacagtgtgtgccgaaaaaaaatgacagagtttttattttcaaaaaaatatacctcaaaaactaaacaacatagggggagatcccccagtaccggacacttaagccactaaattcataattcgaaaaatagtgatttgatgggctcgtgttatccatttatgataaatattatcatttttatagtgtacaaaaataaatttgaaaatataaatatgaattttgacattgagttttgaagatgtatcttagtaccaaattgatcgatcttgaaaggtggcacccaataccggacacgatctggaaatgcctcgaattctgtaaatttgaacatcattgaatgtctacactatagaaatagtttcaattcaatgcatttgcaacatttacaaacataatttaagtttttcttagtttgcaagatgcctatcaaaaacctctttcatatatgatgaaaaatagcacattttacgatgctgttatgaatgttcattcttcttaattttattgcatgtttgataccatggtcgacggaacccatgaaaaatggaagtattttgagacactgatgcaataattacaaagatatcatataacaaatcaagctgtccgaaactgagggacaggaggtgcttaaccaaaattgtaagttgtccatatttacttcaattgtggtacaaaatacattcatactatcaaattaggattgtgttcgatcatgcttgcgggatccaaagtattttttcgtgttcaaaataattactaaataggctcaaaattaagaagatacgtcaatattttaaagattttcaaacttttctacttttttaaaaagggatgcatatttcaaggatgtgttattctacgcaaacattagtctacataacagctttcttttctactaatacaccatcttgattggaccatgatttctcaatgtttcgactttgtccggtattgggtgctgtccggcactgggggatctccccctacatttgacagtaaacgtaaaattttctgaactttcaagaaaacctgagaacagcaatagcccctttgatcccgaggccttcaaaacacgaaaaaacggaaatttttgatatttttggatgtaaaaaaaacgattttcgtaaaatttcttttcttaaaaagtcaaaattttttgctttcatttcaagaaaatcaaaaattggttcaaaagttatgattttttaaaaaataaaaattttgctaagtcgcgatttttctggtcaccctattttggaagtggtcaccctaacaaaaaaaatccgcaaagacgtgcatccttatttcggataagaatcaaaatagcaaattttcacggaattcggtgacccactggatcggtttttcatggaatggctgtattcaaatgttgaccatgaccctatgcatggcgagcgtttgatatgtacagtcaactctcccttactcgatattccatatctcgatatcgagttaaaggaccatagtaaaagttggttttcatggctaactcaatggtcccttggatcgcagttgcactggttttgtgttctataacgcgatacctccctaactcgatggtcccttcaatatcgaggtatgcagagttgactgtattataaaagcttattcttatctaatggagtattacaagaccacgcggacaatttcgaaccaaattatttctataaggtaccgcggggcaagtgggtaaatggggtaagtgaaaacaattgatatatatttactgaatatgtgaattaacgttttaaactcatgcgtaaaccttttgaggccattgagaacattacgataggtaagagatttctgagatttttcagccaattgttaacctgtcaactgttactccgtaacaagttggcgacgtacaatcttattttaatattttcagtggaaaaaagttgcggaaaataatttcctgtaccactttttagttgtcctctgtgacagtttcaaactgcaataaaaaagttttagaattaattcgacgtagacctaaaaataactaaatttaaacaccgtcaatttccttatcaggtggggcaagtgaaaagtttatcattagagattgaatttgtgttttctctttaagtaaccataagtaaacatggttcgcaattatcatagaaaaacataacgtgctgataatccaagaaacactatactaaagcgttaaaagctattagaaatcatggacattctctaaaagatgttgccaaacattacaatatcaatatgtctacttcgggcagccgaataaaagaaagacgttgactgaaaagttgcaatattagagaacacacggaaatctcgtggaatgtctatgtaaacctagttcagaacataaaaatggggtataggtctatccacataaaaaagaccctaaatacgttattgaaggattccgtttgatttctcccgaagagttatccaaagtcatatccaactttctcaaaaacaaataacgagcggtggaaattctacagcgcagaaatgcaattgctgtcttataatgtaagacctaacattggaaatgttgcagttataatgttgtcgaatcatttcaactaacataactgaacagaagagaattgaagtgaaaagaataacattttctttacatgttacttatgttattgttcattgggaagccttaacaagtgttaaagctaatagaaatctattataatataactgtttgtttttgaatttattgtacaaaacggtaaacttttcacttgccccacttttggagaaagtgaaaagtaaggagacatttttcaaaaactttttctgtatttatttcttcaatttttcataaaaatcaatttcagcatgcttcttatatttggtgggagtaaagctaaaaaatatacacgacctcatttgttttaatttaaagtctctagaacagtggttcccaacctttttgaagttgcgacccccttttcgatttttataattttccacggacccctgaaaataattgttcttgaaatcaaaatttatgaagacgaatgatttgtctgtactacatacagtccttgagttagttttaaacattgtagggtgcagagctacttccataattccctttggcatggcattctcggccgaattgtaaaaaaaactatgcaaaaagaaacacttcaaaacgacgcatattgtggctaaatatgagctctaaaacttaaaaaaaaacactgccaaagttaatcaactataatcatctcaagacatccatcaaactaatccttagaaattcaaccaggatcttggagaaaatgcggtcaagatcttgtctgatatgacaagaacatctttaccaggctcaagatttttttatcttccacaaatcatgtaataaaaaactctggaggagttcaaccatgatattgggagatgactatacgtagcatctttcctgaagttcactgaataatgttcaaaaacgatcttgccaaaaaccagtcaaaattttataggtcttgaagaagattccaacaacagatcttgccaaacatttatcagacatttcttaactttgttaacagtcacctcagaaatgccccaaaaaggtcttcgaaagacttgcaatatttcctcagaatttctactaaatatatgactagaaaactacaaaatcctagttagccattctctaaagactggaatatataaggtattttctcttgaatgggctatagatttttcaaggaatgtttttaagagctagtgatgggtcttggggagaaaccgctgaaaaattccactgtaattttatgcggactttatcaaaacatcgtccaaaattatataaaaaatctaaccagagtcacgtactgctacagatgtggaatgtttcctgtatgataaaaaaaaatctgcggagaatctgtaaaatatcttcagttgataactttaaaaataaattcgctattccaatagaatcagtcaagaatctcggaaataaattatctggagtcccactaatggttagggaattatccccacaggattttttcaacgatatcagaaattggtaaaaatctctggtaattctgtaaaagattgagccaaaaagtatgttagaaatattcagtggatacctttagaaatgatctatgtaattacttctgattgagaatcataataagaatctcaataatttgagtcaaattttacagtggcctcgcggaccccctgagaatgcttcacggccccctgggggtccgcggaccaccggttgagaaaccctgctctagaatttgaagaatctcaactatgcgaattaaggggggtccgtagccttgaggttacgctttcgcttcataagcggaaggtcatggattcaattcccagcccctccaaaaaataacccgtccagccaccagaagacgccgcatggaggaccgtgcttaggggtgcacatccatcctccgtcagtatcagatggtgactgagacaaactgacccacttcgcaggcagctagcctcaaacgactcaggaacacggcaaaacgaaccaccgcaagagcaatggactctgaattgattggaccaacagcagagcactctcctacctgctcggtatgagagcaaaagggcagaagagagtgaaagcagatgtaaatatagaatagttaaaaatagaactgtatcggtaaggaagatacagataaactgattccggcacagtagtggccacaagcacggagtgccttaaaaaaaaaaaaactgcgaatttcattacccacttgccccacggtaccttacatcggtcttatgaaccgaaaggctcacctatgctgtaacaaacgtaacgcagtgtgggtgcggttgggctctgcgttacattcatcattaacttttgagcttatgactatggggactttgaggtgcagatgaatcgggcttcagttctgcggaagcaccgttcttaagagccggacagccgctcaggctaagggcttgatcgatttgaccaatgcgtcatacacacttaaattattttacggattcctgtgaaattccaacagctgaacagttcggtaaaataaattaactgagtacggtaaatttttacagtattcggtaaaaaatcaccggagtccgttaaattccgatgaagttacggtgttctatttcaccgaactgttcagctgttgagattacggtgaaaatcaccgtaagagcttagtgtgtagactattcagccattactcctcctatcatcggctttggattgacttgcgctcttattgccctacccccactcttattgcccaatgaaaatgaaaaatgaaattttctctatggaaatcgtatctattcgttagcactgcacgtttcacggtatttttcgcgacgatatcgcaatgattcacaataaaaatgatcgtgcatcgatcgaagcatgtccaccacccaatacaccactactatatctattatctcatacaatattgtgaagaatgaattacataactaaccaaaatactgaaaattagtcattttagttatttttccttccggaatttagtccactgtgttagtgttagtgaggggcagggtgacaaaagtaagaattcaaatttgttccagcctcataatgttgctctataaaagcgataagattgaactttttgataacgattaacactgacattcactttgcaagtgtatcattatgattagatatcaaattctgatttgagattcttggctgttgggaacgttaggagtcaattatcaatattttctcccttttctcgataagccattgctttttgtggtgttgcaacacttggttctataatatatttgcgtaaaaccattgaacaagtttttaaaatatctacgatattatctgttttttgacgccacaatctcatttgtatggtatcagtgaatatttatgagtataataatttttcttccagaaacggaagatggccagtcggtctcgccgctccatgacattcccctgtacgccaacgatgccaagacggtgtacaacatggtggtggaagtgcctcgctggaccaacgccaagatggaaatctcccttgccgaaggattgaaccccatcaagcaggacgtcaagaagggcaagctgcgttttgtggccaactgcttccctcaccacggatacatctggaactacggtgcccttccacagacgtgggaaaaccccgaccatctggatcccaataccggatgcaagggagataacgatccgatcgacgctctggaaatcggttctcgcattgccaagcgcggtgaagttgtccaggtcaaggttctcggaacggtcgctctgatcgatgagggtgaaaccgactggaaggtaatcacgatcgatgtaaacgatcccgttgccgatcagctgaacgacgtcaacgatatcgacaaggtgttcccgggtcttctgaaggccaccgtcgagtggttcaagatctacaaaatcccagatggcaaacctgaaaatcaatttgcattcaacggcgaggctaaggatgctgccttcgctatcaaggtagttgaagaaactcacaagttttggcggacgctgatcaacaaggagattgaggatactggcatttcttggtagatattatagtcgatcaataagagatgcacaactcttgattaccttcttttgtagcttgaacactaccgtcgaaggatctccctatctggtggcttctgatgcagctgaagaagtgcttgctaaaagcgcaagtggtggaaactctgaaccccacactgatgccagtaagtaccctttgttacctgcactaattaaattttggtattggcactcatttttaagttcatcgtaataactcgctttttagagtacctttcctccgtttattgattttatttcttcctttccattccttgcaactattgtagttcacaagtggcacttccgcgaagagaatgcttattccaagttgtagttccgcactgcattattatctcacgagcgtagaccatcccagaccacgcattcccactgatgtacgatggggctatcgaaaaccgcattttatcactccacgcttagagacaatcctaatttacgtagtagagtttccgtatttattaaactttgtagtttttcggtagatttggaatagaaagatgattttactttatttgtgtagttgacgttcaaatggtttaacaagtaaaacgatgggtttaaactaagtattacttctgatctaatgaatagcatgagttatccgaacgcaaatcccctctgctgccttgcttaagatttcggctgaagtcgtcccaaaatgtaatcaatattttgtttcatttcagttgacaaatggcattacattaccttgaagtagggtgatcacgtgactggctaagcttaaatatcttggaaaacggtattaacacaacaacatatgacggaaatcatttgaaatagatgcactcgaaactcagaatctcagaattcatttaattgacgatgacatcgcatattcgggtttgttttttaattgcaataggcaggggcgcttccttagcttagtggtaaagtccgcgactacaaggtaaagccatactgaagatgtccgggttcgattttcggtcggtcctagatctttacgtaataggactggacatagaatatcatcgtgtctgccacactacgttataggctctaacattgtttaagtcggctaggagaagcagtttgcctaggctacttctgctacatgtcggggaaaaaagggtctgaggccaaccgtaatgtttggcattatgtacaccactttagcaattcagcgagaattgctattctatagtacatgggttggttttaaaggatcgtcggtggagcggcatccccacaaaccctgagttaccttctcaggggtctgtttgcagattctcccctgtaaaaaaaacactacgccacaaatgcgaaaattgcaacattgcacattggggaattccgaacccgaaggtggaaaaaattgataaatttcacaatacagtcgcctctccacatctcgatatcgaagggaccatcgagataggga

SEQ ID NO: 164 - DNA, 18156 bp, Aedes aegypti
aatttagcattaagataggtcatgcacaattcgaagtcttaaaacaaactatttatcaactttcgacacggctaaaagatccagctgctcaccgataatcgattggccagattggccactttctaccgagacacctttccttccacttgggagacaaataatttattgacaaacagctgtgcttttgttttggtttcgactttttcgcactgtttccaaaacaaaataccgatagagagcttcagttgcgctggtgttagtgtgacttttgacggcagaggaagtttacttttgctccaacgccgcatttcttagaatcgcgtttctcttccgttgaattacggaacataccatatttattacaaattgataattactactaccgcgcacctgcaaaccgtgcttaacgtaaacttcttataaatcctacagtaagttaaaaatatccctctttttcgcgatgttgcaattctaacctcccatgcctcttccttctccagcttcaaacccatgtgatagagcggtttacacaattctactcacaaaattccgggctccggtcacgatattcgccgatttctgggtcacaaacgcattaaaagtaatccactgcactgaatacggtaaaaacgcaagtttattcgcgagaaaatctttaaaaatcacaagacaaacaagagatgcacttccgcactgaagaaccgcgtcgcgcacaaacagtggagtactattgggagagggcgtgtgtacaattttggtatgcaaaacgcttgctgttctgtactttccatgggaagtacctaattgcaaacgcccacgaaaatcgatgccaagtgtatcgaaaattgttctctgttcgattaattattgtttgatttaaatatgatgggtatatattaaggataatatgttataaaccgatatcaataatcaaatctggatcaattctgttaagtccttttccaatagtactccgtttatatttttttcaaaagcgttacgcgataactgtcaccgcgtcgagggaaaagacagaagcaacctgccttgccttgcacggtggtttgcgaataccctttaatgggtaaaaattcacccattttcgctagaagtgcctctccacatttaatgagtaaacacggtttactctttaacgggtaaatgcggtttctgtcaatggatgggtattttttaccctttgtggaggtgtcgaatgtttcacaaatgggtaaaaaataccctttttgacaaccatattttgctgagcgtttcaatataatgcatacaaggtaattttatcatgtaaaataatattaaacaataattgggtcctaaaactttaaatgaattcttgttttaatttaataatatgaaagagcatgttctttcagccactttagcaatttttccagctcaaataactgctataacatctttaaactttaattttaaaaatagttccaaatatgaaccttgacacttttgaccatgtttgacgttcactttgtcgaccaaaatgccacaggggttttagtttcaccactgagattgttcctatctgacatttcagaaggaatacggaaaacaaaatatacccaaaatttgagtttaaaccaaggggtatgacaaaatctcaaaaatcgttttttgggcttaaacaaacgataatcatttgaaaattgcgtaaacatgtgtttctggtctaaactcaagcgtttggtaccaaaattgagacagggctttaggaccctatttattcagtttttattaatctctacatttgattacatatttaagtgttgacattcaaaggcacaggtctgtgaatgttgcttccagcttctttacaagttcgtccttttttttcggtcggagatctggaaaaatgcaagaaattcgaaataattgcaatacatttttgatatttctatatgattatgatattcgctaacagtattatacttacatgcgcgtacttggcgtcctagaagatgataatatcacagacaaacagacgtcacactctcatcattgtccatcgaccacctttttaacggtcgattcaaaaatatggtaggtggccaatccactacccgcagcgctcacatcgtttttgttcgcgtttgacgtttacacactaccgccatctgttggtccgtcggccaaacacactaattttagcattgggcgtacatgtcctcgtgactatgattttgatcgagatttgttctaagtgttacgtctgtttgtctgtgataatattatattcaacggctcgacgtgactattccgccaactgaaggtggtcgcgcaggattccaactaatttttcaccctttaatgagtaaaattttacccgtttttacactgtatacgagttagaagaatgagtatttttttacccttttcatgattgtgaaattcccccattttatgacagatatgattactagtgatcctttatagagagacacagacaaacagacgtaacactgaagaaatttccatcgaccactcatttaacgatcatttcaaattcgctatgttacaaacctcacaaccagaggcgtgcacatcgtatttcttcgcgtttgacgtttcacactaccgccatctgccagtcttgttgcacgaaacaccttttcgtgcaacatgctcaccagatgatgatggtgtaaactgggcgatggattttgaagaaatttgttctaagtgttacgtctgtttgtctgtgagagagataagcgaaagtaaaatggaatgatttggcaacagaccagcagtgctgattttgctcggcgtcgagaataatattgtaacacggacatgacttcctcattgctataaagtgtattttgtttcgttatagatctttgagctattgtgcatcctgataaaattcagaaaaagaacttcgctcaatttcctcttctttatcaacgaacttaaggtaacacacgatagactcatcgtggcatccatgaaaaatctatgttcaaactatcgttgaaaagaaaatatttctgttttatatcatatcggtcattcggtgatctatcggatcatatgcttgctgataacaggcatgttgatatactttcagttcatctctgtccggtagaaccgatatcacatccccaaaactacaaaattgatcatcgtttatggatagcaaacagttgcaccttaagcaccgccaacacattttcaatcggaaggattttggcgcgctcgaactgacaaatcctccgttgtggtgaaacttcttccttcgacgtgatattggactgttttcaaaaacagtcgagataaaagccgagccggcagagcaatgacagttagttcgttcaaaacttcgcttcggaagtccaaccggcgaactccagattggtgctgcgaagtcaatacatatcaaaactaataaacagccgaaaaaatcaaaaactaaaaatcgcattgacaaaaattgggtcctaaaatgtttaatgaattctcgtttttattcaataatacgaaagagcatgttcttgcaactactttagcaagttttcccgctcaaataacggctatatcattttttaacttcaattttaaaaatggttctaaatatcaaccctgacacttgtgatcttgtttgacattcactttttcgacaaaaatgccacagggcatatagtttgaacactggggttgttcatatctgacatttcggaagggacacggaaaacaaaatatatccaaaattcgagtttaaaccaaggggtgtgacaaaatctcaaaaatcataaaaaaaatgttttttgtacttaaaccaatgaaaatcatttaaaattttagtaaacatgtgtttctgccctaaacttaagcgtttgataataaaattgagacagggctttaggaccccattcaaacaagtaaaacatttcattttttgcttcatgcaaaattacttttaccgaaataatttcaagcggattacattactcctcaagaaaagttcaaaacaaacataacgcatgttcgtttggctcacactttgacagctctcgctgctcgattggctcacactttgacagaaatgtcagcttccgcgaatctctcttataaaggatttctaatgattactagtgattctttatagagagataagcggaagtaaaatggaatgatttggcaacagaccagcagtgctgattttgctcggcgtcgagaataatattgtaatacggacatgacttcctcattgctataaagtgtattttgtttcgttatagatctttgagctacatatcaaaactaataaacaaccaaaaaaatcaaaaactaaaaatcgcactgacaaaaattcaaaaaagtaaaacatttcattttttttgcttcatgcaaaattacttttaccgaaataatttcaagcggattacattagtcctcaataaaagttcaaaacaaacataacgcatgttcgtttggctcacactttgactcttataaaggatttctaatgattactattcgataatgggtatttttttacccattaaaaggtattcgcaaaccaccgtgtgcacggtggtttgtgaatacccttcaatgggtaaaaattcacccatttccgctagaagtgcctgtccacatttaaagagtaaacactgtttactctttaaagagtaaaagcggtttctgccaatgaatgggtattttttcacccgttatgtaaatctcgctcgcggcaaaaaaaagggtaaaaatttacccattttttgaatgatttttatcgataattataacctcgaaacaaatcataactttggaatgaaagttactaatgaaaaatgtacatattcaggcatttattgctttattgacttccgccaccgcacccgcacatttttctaagggtgtattcacaaattttaaaacgtcaaaatagaccattttcgtgcgtacaccccgcgcatatcgacgccttggtgtggagtgatgctaaaacgatacataaagcgttcgtattgcgataatcgttccatctttcataaggcaatatgtatggaatttgatagtccagttcgctgcgtgtatgatccgtaacatcacgaggacatccacctacctcctttatcgttatgaaatttgtgaatgggccctaatcgcattacgcgttcaagtagaaatgtaaattcaaagggggctctttgttggaattttcttgacccattcagtgaaggaattttgttacttttcttgagcgaaacagcatacttagggctcattcatttatttcataaagctaagtatgctgtttcgctcaagaaaagtaaagaaattccttgactgaatgggtcaagaaatttcctacagagagccccctttgaagtgacatttcttctcaactgcgaactgcgatcagaaaaatgtgattttcttgaccatttcttggaagaaattttccacgcatcgagataggcgattccttttcttgtcagtagcaaaccagccttaacgctgaaattggcctttttggacacccacccactcccttgtaatgctttttgtatgaatattattcaatttttgtatgtgctgtaacatcgtagggacacccacccaccccctctagcgttatgaaatttgtgaatgggcccttattgagctctcgccgagcggtgttacgaacacgtgcgcaaatttgctggttgaaaatactgccatttgattttgctgggaacagctgatctttgtttatattttcaaccagcaatctttaagtagtgttggtgacatgtgacgtgtatgtacacgagcgcagaaaccactattgtaagttcggtcaatcgttagaaaatgcttttcgccgaagttggatttttttcggaatccgtgcaaggtaccctacttcggaagtaaaaggcgcattcgagagcatccagatgcgaatcgaatgcatcacttccggaattaggtacctccgatgatcggcgataggttgtgagaaaaattgaacttcagcgaggaaccattgccgacaatagcttaaaaaagaaacattgtaattgagcgcacgttttaggcgcataccacgcataaataccttgggtcatcccaatgggttgacccgcaaagtttgaatcattctcattgtgtttttcgcattttagcaacacgtcgcgtaacgcaccgcatctgtcactgtcacctgccgtgcacgcatccgaatcagaagcccaaaagagaagtcgaaaaatttcactcatcgtgtgttggttgcgtttcgcgattttctgttcttgcgattcatgtgaggttctggtgcctggatttcgcaagaaaaagtttatcatcgcgcacataagcagcagcagtaggagtagctaagtggaaatcgatttactcgtcgggctttcggacggaaccaggttctcgggcaggagtagaagaagcgtgccgtttcaaaaagtcggaatcatgtccggagcaaacatcacccgaaacgaagtggtgcagtttgtgctgcgtatttcgttggtatcgattgtaacgtactattcggccaaatggctcatgaagaacctggacccgaccaacaagagcaagaagaaggccatcgaaaaggcggaggacattctgagaaggtaagtcaagagagttccgtgggtcgaaagtccaaaagtcacgtctgggcatcgggaactattttcggaattcaatgctggcctctttcagaggcgcctcgcgaatgcagtttcttgttttcttttctgttatataatgttgatagatgggcgcatttggaatttattagttttgacatttgcaacatggataatccttgaagaaagtggttaaattcttaaattttgatgttaaagtaaaaacacgatcaagtaaaaagacacttgtgcagggctggtagcagatatctttttaacagggtgtttactacctggaaaaacctggaaaacctggaattatcagggaattttattcaacctggaaaaacctggaattctcagggaatttcggctccactcagggaaattattttgaaacagtaatagatggtataatatgtcgtttttgtgacaacaaatctcctcaactaaaaaaaaagttcctctgcgccgctatcaaaacgctagttgacaacgatttttaattaatcagcataaaacatgtttagacaaggacacttaagattaccaaattggtaaaggcaagtacagccccaattaggtgtcgttcataagcagttgataagttgaaaacattcgaaaaaaatttacagaaatgtttttttcatctattatatcaaaataataaactttgtaagaaaagagcaaaaattacaacagacacgaaaaatagtacatttttcaagtaagcaaattttctttaagatacttgatcactattttaatgcaagtctctaattttggttatggtctctaaagtctagtttaatgaaaattatctctaaattacctttttgaatctgcttgcagtaaattttgatgcaaaattatactataactattaggcttttaggtgactactccaccttattaggcgactgttccacaagttcttaatgatatttcttagatctcgcgaggaatgcttcagtcattctagtaatttcttctggaatactttcagaaatgtctctccagatactaccagcgatttcaatggatggttagaggcatttcttcagaatttggtccaaaaatcctaaagcattccaacgcttcctcaaaagtttattctagagtttttggaaaaaaatgtttcgacatttttctacaaaatcctataataatccctaagccaattttttcatttattccaggcattttcataaagtttttttcaaatattcatccactgttactctcaggaattgctccaaaagctcatcaggctttattcgatggaattctcgaagaattcctcgataaatttgacataggattcctcattaagttgctccagaaacttatcttggaatgtcttcaacatatcatcaaaatattgttgctgcggttcaaacacttctctaatattttttcaaataaaatatccatggattattcaaaattcagggattcggtcggaattgctccaaataatttcttcaaaacgtcttgtaggacattatctgaagaatctaatttatgtttcaaaaattttagaaaaaaaaatcaataatttccagaaatcttggatctcattttaagaaatcttggatctcattttaagggtcactattttaatgcaagtctaaaaagtatctgtaagctgcttttttaaccaaaatgctctctagagtcacctttcccactctttatactggtacaaaattcaagacgatccagagaaactttcaggtactctaacgcgattattctatagattctcttggaagtttttaaaattacctaaagtaataagacagtacttctcagtgcagtgctgtacaaaaacaatacttttcagtgctaaaaatacggtacttttcagatcgttgaggctcgtaccaggcagatgaacggcaacgtttttatttattattacctactggaacatatatgaaacatatattgactctaattgatgttaacattctttacaaacaaaatttgatattgtcaattctcatgaaacttttaaaattccattgttgaagccaggagcattgcaattccaaagtgtgaagtaaaatttgaattcgtgattatatacgatgatctcaaactcttattctgtcttaagaacgtgaaaagaaggcaattccaatgcactcgcgatcgtgctgtgaaaattatatggcaggatcgcagaaagaaatctcacgcaacgttacaaaaggacctatcttacattgagaggctctctttgtttactttcactttaatctataattgagtcacatcaacctcttcttttgattttttgtttgaaacgctagtcaatgaaattgcctttcgatctatagggaaaaacttcccaaaagctttagtatttcactgttataatcgaaagagaacgagagaggagagaatctctcatttgtagataggtcctttagtaatgttcagacagaaattcaaaaacgattttcacaattaagaaacaaaaaaaaaaatgaaaataaaacttctcaattgaaccctggctctgagcccttttggaaattatctaaaattttgataaaacctcagaagccaatatcggcattgcaggaggaaaacaaattactactaactaattgcgaaaaagctcaaaaacttgctatgcagtttgaaagcgcgcaatattttaattcaggacttactagtccaactgaaaatcaagttagtcaggacttcgaaaatattcttaatcaagagaacgttttcggaaattcctgggagactgatttggaagaagtgagaactattattaaaacaatcaaaaatatgaaagctccgatggggcgtagatggaattttcttcatcctcatcaagaaacttccagaaagtagcttatcattcttagttgacatattttcagcgaatatgctcaattgaagactgccgttatctccaggaccagataaacgtcttcgctggatggtgtgttctcaaccgactagtcgtcaatccagcaaagtgctccgtaatcactttttcacggaagaaacagccgataatcttcgagtatagcattttcgatacgccaatcgaacgagtgcagtgcgttaaggatttgggtattctgttggattcgcaactgacattctcccatcatatcgcttatattgtcgataaagcataaagaacgtttagcttcgtcttcagaactgcaaagaactttaccaacatctattgcctgaaagcgttatactgttccctcgttcgagtaacattggaatatgggtctgcggtctggagtccgaaccacaacaacggatgcgagcggatcgaatcagttcaacgagatttcttcgttttgcacttcggaggctaccttggagagatcctttacgccttccgagttacgagagccgctgccaactgatcgacttgcaacctttgcgaattcgaagagacgtttgtagagctttaaccgtcgtcgatactctaaatggaagaatcgattgcgaagctatcctgcaacaaatgcatctcaacgtgcaacctcgtacactgcggaatagttcgatgatgaggcttccatttcgtcgcaccaattatggattgagcaatgctgttcatggtctgcaacgtgttttcaattgtgtggcgtcgatcttcgatttccacctgacacaaaatatgcttcgccgtaaattttctagttttttcgctggccggaggaactgaagacatattttaagtttgaaatgttttacgatcttgacttttttatattcaatgttttgtcacgtttgttttgttatatactatgtattttttttttatttttaatatcaattggactatacatagtctgttgatgtaaacctaaataaataaaatattcgcatagcagtcaaatgttttcagttggcatattttcctgacaaatggaaaaatgctaaggttgtaccaattttaaaatcagacaaaaatcctgcagaagcttctagctatcgtacagtttgttttcctccgtcagtaaacttttggaaaaggtcattttgaacagaatgatggtccacatcaacgaaaattcaatttttgccaatatacagtttggattccgccatggacattcgaccattcatcaacttttacgtgtaacaaatttgatccgttccaacaaatctgcaggctattctactggtctagatagagaaaaagcattcgacagtgtttggcataaaggcttgatcgtaaaattaaaaaaacttcaattttcctacatacattgttagaataattcaaagatatctgtcatatcgtacacttcaggtaaattatcagaactccagctctgaaagacttcctgtaagacctagtgttcctcaaggcagcattttgggaccaatattatacaatattttcacatctgacttacctgaattacctcagggatgtcaaaaatccttgtttgccgaggcctttccaccaaaggacaaagtctgcgtgtcatctgtagtcgattgcaaaaatgtttagatatattttcttcatacttgcaaaaatggaagatttctcctaatgcttccaaaactcaactaataatattcccacatataccaaaagctctttatttgaaacattcaagtagacatgttgtcacgatgagagggattccaataaattggtcagatgaagttaagtaccatcagtgcacaagtatccgctcatgcccctatttccgctcactagtgtaaaaattgacttttcgtgtcaaaaatcatcatttttcgcacggatatattctagcaatattaaaaactttcaaatgaagtcgtcttacattattttcatttgataaaataattttttatattgaatctgtttaccgtgagcggaaataggaacacttagttgcagtaacaaatgcaattaaatatttttttatgaaggtttttcaaattctttttattttgctgtcgattacatatgcttggagctacattgtgacatgaaaatagtattgatcgacacaatagttattttataataaacatttaaacacataacttcccttaaatgagcggaatctggtgcactgatggtatctagggctcatgctagataagaatttaactttcaaaaatcacattgagagcattcaaaccaaatgtaacaaatatgtgaaatgttatatccccttattaaccttccagtcgcggcgcggttggccaccgtcaaaaccaccacgctgctattgtgaacgaaaagcgagctttttttcactagtgttgtacaatatacatacaacagcgcgacgactgaaatgttaatagaaaatcaaaactttgtcttaagaacaagcttttgatattcagacaaattttcaggccagccatgttgtatactgtaccaataaggactaactgttgtaatacctaccaggaggaaagctctgcagaggattcaaaataaaattttgaaaatgtatctgaagctcactctttggtatagtactaatgagttactaatgaatgaaaatctttgaatactatagaaattcatgatggaatctctggagtattttctgtggttatcaattctctcccttttatctcctgtttgctgtttagataaattatgtttgttgaatggtctcttttgagttcctgtttggtttctgtacgttttcttttttcaagtttctattgctaaggcactcactcgctatcaaccctgcttatagatttacgaaccggtgtacacccgattctgtttttgcacggattttttttacacggccgtgcaaaaaaagtttccatacaaaattttttgccaaaaccttatttttacatgaaacgtcgagaaatggtgttactttttttacacggtttttgaaattttgaactgaaaacttgttttgcacggtacgtatcccccgtgcaaaaacagaatcgggtgtatgtcagtggacttcaatctcgtgaatgattcgttaatcagttgcatttatttttggtttcattcatctctccttctagacttggcccgaacatcaaaaagagcgccctgactaatctgaatgactacgagctggtgattgcttcgcatctggtggttccggaaaacatcactgtcagctgggacagcattgccgggctggaccatgtctgccaggaaatcaaggaaagtctggtcttcccggtgtgccatcgagacatgttctcagcgtcgtcgctgtaccaagcgccaaaaggggttctgctatacgggcctccaggtatgtaaactacttattgaactaaataagtacatgggtgtagccagaagggacagaggatgaggggcatctatcaaaatttctggtttccgccaaagatttccctaatcatttgcgggaatgaaccacagctcttgtagagtgtactccgtttgccttcacaaatactctggtattccattcaatcgtcctgcttcgaataactgagatcaatttcttagccttctgagcttcaaaagaaccctcctgagggtcgcgtcctacatagtttgggaaaccttaaattattctaagaattcagggtgtctactacctggaaaaacctgtaattctcagggaattttggctacactcagggcaattattttgaagcaatagtgcatggtagaatagtcgtttttgtgaaacaatatcttttcaatcaaaaaattttcgtttgcgccgctatcaaaacgcaagttgaaatgtgtagtgcttttaatgatttttacttattcagtgtaaacatggttaaacaaggaagcaaaacttaaaatagccagtttggtaaaggaaagtacagttctagttgggtgtcattcatgagcatataaaaaatagttaaaaacattccaattaaaaaaaatcgtttgttatacaaaaataataaactttgtaggaaaaacagagaaaaaaaaatcaaaaagtacaaaaaaaaagtatattttgaaggttagtagatttttattatagtcaattatgcttttcggctacgcagtcttaatttttacaacggttttattatagttttagtcactattttaatgcaagtttctatttttggttaaggtctctaaattctctattttaatgaaaatagtcgtcaaactcacatttttgatctgcatgcagtcaatccttgtgcaaaattctaaagactccagagaaacctacaaagactatcacccgattattccacaagttcctaatgatatttttctcagattccggcatgaagccatttgccataaggtcatttggcataacgccgttaggcactttcagatcatttgataatcattctttgttttagtggagctataacaaaattaccattattattgagctctctacacgtttaaaacaaacaaatatttttttattgacttttttatttaagtatttcaaagccaaatttgtagtcatctaatatgaaaaattcatctttatgtcttttgaagaatttcttgaacctagaattgttttccagaacctggaaaatcctggaaaaatcagggagttttatttctgtaaatgagtagacaccctgaagaagcatctaaataataaccacttctgtgtgttgtgaaattaaaaaaatgtgtagcagaaatcagcgcaaaattaaaggatttattcatagacttttctaggagattttccatgaattctttctcaacctttttctaagatttttttaaagaattgctggaggaatttctcaaaatcccagaaagaacaagtgaaggactctcatgataaattcctggaaaaatccctgggaatactccttccgaaattcctgaacgaatccctgaaggcattataaatctcaggaggaattttcggaagaatttcgcttagaataattgggggaatttttgaggaacctttgtacgaatctcctaatgaactacttgggtaatctttggaagaatacctacaggcatctctgaaaaccttccatgaataattcctggaaaacccctgttatgataactagagactcccatggagaatttattgataaatcccctaaggaaatatcggaagaattcttcgcagaatcttagaacataattttggaggaatcacaataagaattcctcgataaatgccggtaagacattctagaagattcaagaggaatgactgaaataattcttggtagtatttctcaaatgatctctgggatagataacagaataatgtctggaagattttttactgtgatgacaggagaaatccctggaagaattcttgatactcaggaggaatttctgaagaaatgtttgtagaaattcataaatcaatcccaagagaaataaatcctggagaaatttccagaagactttctgaagatataccagaggcagggttggtaacaggcatctcttggtctcttttttaatggaagtctcgaaaaagtctctttttaatggaaggtcactacagtctctattttttacacaaaatcgtctttgaagtcattattttaattttcttcttgcagtgcttccaggtacataattctagaggatccagaaaatcttcagagactcttacgcgattattctccaggaattcctcgagggaaagcttctggaattcttcagagattttgtctggaatacttttaggcattgctgttaaatgtcaaaatttttgcgaaatatcgcataagcaaattttggtaaccgatagaaattctgaaatgatcaccggggaaaacattttctgattactttttccagaaggaacgatgatattagcaatatttaaatgtcaaagtctcgtgatattcataatatttaccaggagcacctccaggcatacctacaaaaaaatcctgtagagatttgtcacaaactgtcctaggaatttgtcaataaatttcttcagagatttttaaaggaatcataaaaggaatttatccaaattctagaatcatcgcaactacctgcattaatttccataggagttactcagatgctatttgaaaattttctttttactggtgtatttttgtacgaatctctggagaaactcctagagggatccttgaagaaattctaggtacaattcattgataaagcttagtcttggaatttctagggacactcctaatcaagttcctggaggtatctcttgtggaattgttaaagtattctcttgttgaattcctggaaaaatccaaagtggaatccctggtggaatgttaggtggaatacctaaaaatcttcttgaaatccctggtttggtgtacaaacaaaagcttggataaactatccattaacgcataattgtcccatgctaactggtctagcaaaaatgagtcttgaatgaatatcacctctagttgtgttacgtttcatacgaacatttagacatacgaacattgccatacaaaggatgtccagtataatcgtttccatgcaaaatatgtaatattatgtttattatcgttcccgaatattcctcaacctccctgatagagaatctggctatgcccatgaataagtaatatgtacattttattaaatacggcatatatttcatttatctcgtaggatgtggcaagaccctaattgcaaaggcaaccgccaaggaagctggtatgcgtttcatcaatctggatgtggccatgctgaccgacaagtggtacggcgagtcgcaaaagttggcatcggccgtgttctcgttggccgtcaaaatccaaccgtgtataatatttatcgacgaaattgattcgttcctccgggcgcgcaattcttccgatcacgaggcaacggctatgatgaagacgcagttcatgatgctctgggatggactgaacacggaatcggattcaaccgttatcgtaatgggagcaaccaatcggccccaggatctggacaaggccattctgcgtcgtatgccagctcagttccacattggactgcccagcgaagatcagcgattgaagattctgcaactcattctgcgccaagaaaaacttgccaaggatgtagaatttggccaactggcacgaatgaccaacggatactctggatcggatctgagggagatgtgccgcaatgcttccgtctatagaatccgaaaggtaatgcgtgaaaagaataaggaaatggccgcagcagcagccgcggccgtggcagctgcagcagctgaatccagcaagacaaatggcatgacgaatggcagttgttccacaacggctgcggttccgtcctcctccggatctccaatgctggacgaagctccagccatcacgatggatgacctaatcgaatcattgcgaaatatgaaacactccaagtacaactcggggcacttgaacgattcacgcatagatttagactaagcgcgcttttatccatagcattcaataaactgagaatcaaatagaaacgcttacatgcaggagtgttgaacattgttccaaacccacgttatgttacaaccctgtacgaatttgattgtatgtgtgtatagttatatttccatctcaagtcagattatgtttgcacaattttagcgctgattagtagatgcaatcgtacgtgtgtatttaaatacccagtggaatcaactaatcgaattatatattatggaaatacaaatagctttcattagcacatacgcctagaaatcctccaatacgagaaagctgaaatgagacgatcggtttgattgtctaaaaggtgatggattaccgttcgaaaggatttgaatttaatggcatcgtgtacaatcatttctcacagaaacgtttctatggtgagtttaaattataaaaaaaatcttttaatttaatataactaggattaggttttcctgtagatactgagaaagaaactgaataaatagtagctatgatagaagcgttgacgaaacatttgtatttttatttgttttagttaggtattagtgaagtttaatgcatgttttacgctcgaaaacaacggaggtcttctggtctgtctcttttaacaactttaaaaacatccccttcaaacactacttctgcaccaacaccactaggcttagctctatatctacctaattcgctgtctttctcttcagaggcatgaaggcctcctcaactgacctgcgatcgattacaacaaggtcgatatcgtccgcaaagcaatgtccgtattacgacacaaacgaggttgacacttctgcattctgaacacttgattcgaaccatccagcgttgcgcgtatcagcctgattattttcgccagatagccatgttcagacattatctgacacagctcattgcttttcaatgaatcgtacgctgtcagatggataatctgcaagttatactcccggaagttatctaagatcattcgcaaggtgaacatctggtccgttatcgacctactcacgaaaacctgcttggtattcgttgacggactcctcgagctgcttgagtctgagcttttaggaaatgttattttgaacaactttgtcagacacttttg

SEQ ID NO: 165 - DNA, 14836 bp, Aedes aegypti
acaaacaaacaaacaaacaaacaaacaaacaaacaaacaaacaaacaaacaaacaaacaaacaaacaaacaaacaaacaaacaaacaaacaaacaaacaaacaaacaaacaaacaaacaaacaaacaaacaaacaaacaaacaaacaaacaaacaaacaaacaaacaaacaaacaaacaaacaaacaaacaaacaaacaaacaaacaaacatactaactaactaactaactaactacagtgaaacctccatgagtcgatattgaagggaccatcgactcatggaaatatcgagtcatggaatagcaatcctttggaaagctacttctagggaccatcatagcaaccatggaattttgtttttagtatggttccatgagtcgatatcgagtcatggaacatcgactcatggaggtatcactgtaactaactaacaaacaaacaaacaaacaaacaaacaaaattggagttgataattttattagtgttcccgacttcgccctttccgaaaatagggcggaattttccagaagccaactccgacactaccaacctgatgacgccaaactgtcatttttcctttttattttcgttcttcgactgtcaaactcagtcccgttcgtttttttctgcgcttgttctcgtgtttcgcagtgctgcgtgcggtgaaaaatcaaacgtgatctcgttcagctagacttgaccatcagagccagcagagaattttcctaacgcaaaatgtacgccccacagcagcctattctcgttctgagtaagtaccagccgatggtttgatgattggggaagtgaaattcattgaaggtgtccgttttcaggtcagaacacaaagcgtgagagcggccgaaaagtgcagctggagaacatcaatgccggcaaggtgagtcacggtcccataagctttgagtttacgcctccgcgaacacgatgaggttaattcttttcttgtttcccgcagacgattgctgatttgatccgcacctgcttgggaccgcaggccatgttgaagatgctgatggatccgatgggaggaatcgtcatgaccaacgatggcaacgcaatactgcgggaaatcacggttcaacatccggccgccaagagtatgatcgaaattgccagaactcaggacgaggaggtgggcgacggaaccacttcggtgattgttttggctggagagatgttggccgtggccgaacagttcctgcagcagcaaatccatcccacagtgatcatccgggcgtatcgggaagctctggaagatatgatcaagctgctggaaacggacgtcagtattccgttggacaaagcggacaagtccaagctagccgaggtggtgaaatcttgcgttggcacaaagttcatcggacgctggtcggatttggcggtgaaaattgccctggatgccgtggagacggttatgatgaccgagaatggacgcaccgagattgacatcaagaagtacgccaaggtggagaagattcccggcggatccattgacgactcgtgtgtgctccggggagtcatgctgaacaaggatgtgacgcatcccaagatgagaaggtatgtttggatgaggattatgatagtggttcccaacccttttgaagcatctcctttgaagttctacaaacatttcgccgacccctaaaaattggttttatcgaaatgaaagtctttcaaagatcttattatgtatcgactgatatctgttgtagtatctggcctacgatcaatggaagcgttctagaactgagattgatagaaacacaagcgccttcgaaattttgcgaacgaattagtcaagctaaaattgtgggcttcgtggccgtgcggttagtgttaccaatcatttagccgcatcgagtgaaggggtgtgggttcgattaccgcttcagtccggaaaacttttcgtgtttgattccataattataacatttgttttccgaagagctgcttaaaagaactctaaagtaataccgataaaaaagaaaggaaacagtgcttctctttcaaatctatggcccataagtataccgagttctttatctaaagtttttgaaaaactgcaaaatacaaattactaaatttattactaataatgttcttttgcatccgcttcaatctggatttcgtcaaagtcacagtacaaattcagctttaatcgaagttcaaatgactttgctcgggttataaagtagagggattgctgttttacttctaatcgattttgctaaagcatttcaaagcaaatcactccaagttggtaaataagttttccttgtaatgctgttaaattaatcgaatcttacttgaatgaacgtcaacaagctgtctttttaccatggtgttttatctgagttcagttctattgaatctggtgtacttagggcgaagtaggtcgtttgcgaattaaagaaaatcactagggtttgcactgatatggctgaaaaagtatcagcatgctttctgcatgtaagcgcaagtagtgatacttttctgaataaatattacttgagatggctgatcacttcgaaattgcaagctgcaaaatcaacatggctgaaataacgaataacaggcaattcatgatttaaaaaacatattgacatggtcagaaaataatccatcatctaaatccatcaaaaactaaagcttatatgacattgcctacattgtaggcttaaaacccgcccgctaccgacataatttttcttatttttcgatggaaaaagagtactgttttatgaaaaaataagaacattttggaataatttttacttcaaatttatgttgagctgcatttagcctaactacaaaacgcttagacacaactatgaaaatcaaattgttgaaatccttaactctgcgtcattttatatattgggatttcttgtttagtaatgcaaatcttttttttttcgtgaaatttggtgatttattgaagttttacggcgtgtgattggaatgaaatccttccgtgaagaagtacgaacacgaaggttttccatagtgaaaataagtgcccggcgaagtaagtcacttaaggcggtaagaaacttgtgttggtgtggctcagtcgatcgctaagcatttctttcaaatcgtgttcgtccatgctatttcggtgaaaaagtgcaaagtggataattgaactgaagttatttaccgatataaagtagttttattgcatttttggtgtacaagtgtacaaaccataacagctttcacaaaattacacttggataatgaatctatgttgctggtaagttttaatatccgccagtggcgcgggaagtgggtaggacaggtaggacatgtactacgcacgaaaacacctgggtaggacagtcaaaggattgtcctacccaagattcaacaaaagaaacacgatcaacgtcgtaaggtttttcattgtattctcatgcctagtaatgtatgacatggtttgcagtgcacatgacctccaaaagttctggatcgtgagaagaacgattgaaatatctgtaatgaacatcatcaatcaatcactaactgtaataattgctacaagaaacttctttaaccattagaaaaacagatagagcaatcttctatgccatttctgaaatattcaattaatggtttcacaagtatatctacgaccaaccttgtatagtatgttctgggacaatttgccgtgaaaattgctggaagtaattcttgataagtttctagagtatctatttcaaccaacatggtatctaaagcctttcttgtccttattctgcttgcattgaaacctgatgcaaaattgtacaggctccaaagaaactttcagagactataacgggttcaacaatctcttcaaaattacgtctcggatttccccagaaaaagcttcaggaattatcattatgattttatttaaaattctttcaaggtcttccgcagggttctcttcaaaattttttctagagatttctcttcaaaaaaaattcctaagaatttgctctaggaagttctaaagaaatctaaagctactacctccagtaattttctcaggtattacttcgattttttttttcaaaactatcctagaatttcctccagatatttttcactaatccttcaaccgaattatccatttgttagtcttctgcaagattttctccatctgttcatgtggattccttcaagaaatcatacatgtttccttcctgaaatccaaaattccttaagagcttcttcgaacaaatctatttgttttctaggattttttccagtatttcatctaagtattactcctacagttttaccaaacatgtcttaaacaagtttctagaaaaattcacatgaaatctacaaaagttcattcaagtcttcacaccagtttatactacagcaaatatttacaaaaattcctcccattattccacaaatttctatacagtttctgtccaatgttttttttccagaaatttctttagaaaatgctgcagaacattatcccgagactcgattgcttttttttataatcttagcaaaatttatttatgagtccaggagctattccagagatccttgtacatcaagggtgatttcaaaacttacccaagttttgtccgaggtttctgtacaagtaattttcagaaattttgcgatttttttcaccacttagactttagtgatctgaatttcgtctttttaagatttcgccttcgatttcgctgccccttttcgatcaccgccgcccatgtaattatactgatgttcatgacagttttctccggcccgctcaatgtttactattttttctttgttctcggctcaccagctggtcttgtgtacacaacaaaaccagctggtcctccgatgtttaggctgtgaatcgtttcaccagttcgtttaactataagttaaaatttgacacatcgatagttattttcccctcaaatggttaaattgaacttcgcggtcgacgcatttgagctttgacagtggagtagttatttcagaataaagatgattagttattctcaaattcagggggacagaaaataactttcgcactgttaagttcaaccatgctccagagcagggttatttctaatcggaggggaattaaatatcgagctgtcaaatttcaactaaaagttaaactaatcggtgaaacggttcacagccttacagtcatcgtcattgtgctcatgctccagctgatcgtgttctcgaccagctggtagtgactgaaatcaaggatgaaaggtagatggtgtttcaaaatgtaccatcagtacattattggcagcttctaaatttcgtcatgatagtctaatcattcatgaaaattacaataccccaccgatttatttttcagaataaatttcttggcgtttccctggagacattccgggaagaattcttgaaaaaaaactttcgttttgaccgggaaacttggaggatgtcccagggtaatcgatggatgaatcactggaaaaaactttgaaaagttatgactttcttgaaaaatatctcgaggaattggaggaattcagatgatttctgcaatattttctagggaaattacatttctgttccaaaatccagattatgagagaaatgtcttctcagatgctatgaagagtcaaactcttatctcctggctcatattagattcaattttgttttcttggtctcttttcgctctctttttgatttcttttatatctccttttggcaagaggtcttttatttcctattttaaggcactcagtcgctaccagctgacatgaaattaggggattagaagcaaaggaatgtctgtgacaaaaaccttattttgtgataatctactttgatttttttttcagaaattgtcattttataaaaattgtgtaggaaccaaagaaaaacagtcttcctagaattatgcttttttagctcaaaagtcacctgaaaatatcattagaacgcttggaaacagaagaatttcctcaactcaactcaactgaaatcaaaacgagcgaaatgtcacttataccgctttgtgtttgagcccctcaaatatagtaactttcaattttcagcccagggttaaagtttttcttagcttcactgcacacataaaaaatttgctaacgtttgtcctacccatggttccgaacgtggacgcgcctctgatatccgccgtagttgaacatttaaagtttgatacgacgaataatagcgcttacgacgaacagtagaacaaaaccctacatgattatcaaacgtaaaacgcctcgctatctttacgacaagctccaattcgcgagaaattggaatcgtttatatctattcttaagtcaactgctattttttatagaggtccacaagcactgccacgaataccaacgcacgatcaatcttacacgagtcgatttcctcagaatgaaaatgtatcgatgtttgttagacgtcatttgagctttcggtcaacgtcagtccaataaagaagtgaattctcggcagcaattctgtttatgtttgcattctcacagcaaaccaagaaaattttgtcaacattgcactactacgcaggcaattggattggtctatggtttcaaaaggggtttacttagagaacttgagcgcgtgcactagaacaataatgatatcaatggttcaatcgccgcgacttgatgtgtcagtgaatcatcgatttgttttcggcgagaagtaacgtacaaatagattgccagattgtccggacgtgtcggtcgttttactggcctacgaccatcttctgcggactctaaaatatattttttaacattccgaacacatcaaaaccataaaattaacaccttacaatcttctagccgtttgtttacagttggacggccatagctattacaaacatcataatacataaatttctacatacaacatacatacaaatatcttctggtcatgtgttggtaatagatttaagcttagttataatagagttgtacgctgtcttaaaattggcatagtctttttgtttgtttacaacattatcatcgcctcgtatcttaatgtgaaaagtttctgttattagtctagtgtagctatttgtaactttgtcaagtatatttgtcttgtcaaagtcgaaaatatgtccttcttctatagtgtgttgtgacaatcctgtaccagatatgttatttgtttttacattatacttatgttgatttagacgtttacacgaaaattgacttgtttcaccaacgtacgatttttcacatgcaccacaaggaatctcatatactacatttatgtttttgtctttagatattttgtctttagtttttgtaaatagtacatctttaattttgtcaactggtttataagccatcttaaagtcgtgttgtcttagatatctagatagcttttcacctagtcctcaatatatggtatcgttataaaattgttcgtagcgttttccttgtcttgtagtgtattgtacattttgtgtagtctttccctataaacttttcctacgaggaaacacgggtagttgtttcctgtgagaatttgtttggccgtttcaacgtgtttacccgatacttagcatgagttaactttaaggctctatctactagtgctattactgtattgtttttgtgtatgaaaggactaacagagataaaatctaaatatctaccgtctgcatctttcgggaaccactccgttgtgatcgtgttgtcttcgcgccacagaatcatgtccagaaatttcagttttccttctacttctaattcaacagtgaactgcagccgttgatggaagccattgaacacgttcaaaaatgcctccacttcctcctttcgcgcacacaacaaacaatcatccacgtaccgcttcatttcgattttatgttgatttgtgcctaagtttctcaaacttcagaaggtacagagatgtggtattgcggagctttatttacattgcaaaagcgatggatagattatcattgtttatcgtgtgctaaaattcatcagaaaaaaataatatatataataataaagatgtattcaaagaccattttaaaggatttttatgagattccaaagattgattttttttttacatggccgtgcaaaaaaattccatacatttttttttcgccaaaaccttatttttgcatgttacgtcgaaaaatggtgttatttactttttttgcacggtttttgaaattttgaactgaaaactttttttttgcacggtacgcatcccccgtgcaaaaacagaatcgggtgtagtatttctaacactcattagcgtcgtctagtgatgaaatataggactaacagggacttactgagcatgcatcacatagtccttaatctaaggaacaggatcttgagatatatgtagagtaaggtggggcaaaagttcgaccttagtggtataatcaaagtttccaggaaaataatagcagatgaaacaaaacaaataccatacagcgaaccttcaacatattggctataacttttctgaacaaacttgtgtcaaaatatttacaaatttttagttaaaacagtttaaaaattgattgtcttaaacgaacttttgccccaccggtggggcaaaagttcgaatctagtgtggggcaaaagttcgttggctaaaacacaaaatatcaatacttttatgccaggcatactttataccagccgtaaacttatgtttgccgaaaaatacacactaaattttcatcaaaaaatgcccaaaacagagttaattgtaatacacccaaaaaatagcagtttttcgcaaaactaagtgaaaatgtaaaatttttgtgacatttttcgcacgatcaggcaaatttcgatgaatttgaagataatatgtagatttcagaaaatttgataatttttccgtgggtttatacatgggtcgaacttttgccccgcagattcgaacttttgccccgctatgggccaaaaattgattctaactatttatggaaaactaatttctaaactaaatttctatataatttctatataattcaatctatattgaaatacagtgggattccgtttttggcatgctccgtttttggcatgctccgattttggcaccccccgattttggcaacaaaatggatccgtttttggcaacatttttcaattccattaaaatttgtaaatttttgtaaatatcatcgtgtctgttgcttaagtcacttgaatagcatgtcaactccacaccgattacattccagatctcctttttcgtcgatgtttcctcaaatctcaccaactactaaggactcgcgtacgcgcttatttccttcagaatggtcattggtcatacataggcaacgtttcatgacaccaataatctccaccagtatttcaacttaagaccaatccctttcataggcattcatattgagtaaccagcccacttgagtctgccagtaggtgatacaataaaaaaaaaacacttcaaatttggaacagcttgttcgaacaaagcaccagcaccgacataagagcaacgaaaaatctaagacttacaaagagttacaatcataaattttgtctcgctgtcttcattattatggatttatatacatggcgtatataaaaacacaccgcaataatagatacaaatatgtacagccaaatgtcgtgtatcataactttttttttaatttcatttaataacatgacaaatgcgaatacagtccaaattacaatttattttcaataataccattgaagctgcgataactacgactgatagtgttttttctttttgtctgtggtattggtgtgtatattgatatttctgcgtcaactattttttaactctcttttttatagactctataaggcgttagatttgttaagagacgatccagaattctgtacaagattgttaatcaaggatacgggtctcaacatcatcaaaatgttccttacgagcttagtctatgagtttcctaactgtaacctggagaacccttaaggataacgaattcatgaggatatctgcagattccaagtggacactgagagcttcttgagggatctttagagtgtataactggttatggagtattatgttcaaaagctggtgattcctaataaactctagggcgtcctgtaagttttaagcgggataatgtgaatttctagtagtatttttaatatttccggcgaaagcttaaggattttgaaaaggttcccagcggaatttgaggtgtgctagtggtagcctaataataataaacttttaatttttttttcatcggagacttgagaattttcggcaacatcacagcagaattccaagatgttaactcatagcaaaatccttagcaagatcctgagaactctatgcgagatcctacggatgcttggcaagatgcttcagagctcaagcgttttttctgtagatttctaatgagaacctgaagattcctataaggttcttgaggtttcataacaggatcctgttaatttcagttgatttcataaggcaggtgtaaaacatatatcaagctgaaataaaaattatttcaagtaaaaattaaattctacacaataacaagacatttatgcatcttctcatgctcatgtttgcccttttgatacagttaaccaatcattataaaatcctttactttatcagaaacatatagtaaaggagcaattccaaactttcgaatttttcaaattttacgttaaagtccaaaagttaaactgattttaaatgttcatttaattagaaaaaaaaggtcatgccgttttgcaatacccagcggccagcgcttttgattcgcaaatacgtcttgaaaagaaaacattttttttcgttttctctcatagttttaagaaaatgtccagttcttcaataaaagtcacttttgcgattattggttttacatttaccgtgtacgcacctaactttgcgcagctccaaactttgcgcatttttaagaagcacgaaaaaatgataattaatcattgatttttttaacaattcagtttcagcaacatgttcgtttatgtgaaataagtatttgacatacatttgtttactaagaaaccctcgttaatgttagtaaataaacaaaaaaccttatcgtcatacgcataaacgtcaacttttacaccttcttagaacaagcgctaaggagtggcactgcaaaaaatcaacatttttatgaacaaaactgtgttgtgaaaagtatatttgcggtgtatttgcaagaaaggtaatattctagtaattccatttgttttccatataatatgttcaatttttatttgaaaatagcgatgcgcaatgttaggacccattttttacacgagggtcttaatttttgcgcacttctagcaattcggaatggcacgtaaatacatgtacgtccttgcatatgacaaaatctggcgatcttaccaggaatggtcactcaatccataaggcagcggctacatgtaatattcttgaaagtaccttttgtatgaagctgaaggcaaggtgtgcatagaaaaatctcggaaaatccactgtattaacacaggagactattactgtaaacttggataattgatagcgcaaaggttggcttcccaattgaaggacaatgattcaagctccagttgtctgaaaaaagcgttcaattatggaatatccatactggcggcaaatagataaaaaaaaattaatcgcgaaagatcaacgatacatctctcagtttaagaattaaaaaaaaaaaaaacaagagaataagttatatgaagcaacgtacgataacaaataggcataagctgcggctgtaaactatatagctcagattgtaatcttgtgaatatatgtattataaaaaaaataagaacagagtaaatctctattcgtgggcactctatgtttgaggtgattgaataaattaaattgaaattcacggaaaaaactcttgatgaaactcatattagttgtaacctttttatttaatacgaaaccagtaaaaaagtaaaattatttagagtaaacgagcaatttaaggcatgcgcaaagttaggcacatcatgcgcaaagttaggaacaattcagattttgtgcgcaatgttaggcacaaggtattgcatcaccttttgcatttttttatttttttgtgaatcatttttattttttttaaatcacgcgttctactgaagggttaaaagcctatcgttggcagaagtttgaataaaaagatacatattttagccttatttgaagcaaaaatacgatgataatttcttaactgcgcaaagtttggtgcgtacacggtataaaaaaaatatgcataaaacttctaaaaaaaattgctgacgttgaggcgtaaaaacgcgaccagaaaatcgtttgccagatttaatattacggagctatagattcatagcatagtataacccttcgaaaaaatgcttcgaagtgaaccttttcgaagtctcaaagccttatgattccataaaaatgatgtattaacattgtaatgatgctttcaaaaccaatggttaaaaaaaaaaaaaaaattgaaatatgggttccgattttggcacggttccgtttttggcaactgaaaatttcaactttgttgccaaaaacggaatcccactgtaattgtaactcactactatctcctagctgtagattgttcaactaagcgaacatgcagtgtatagttatgtgtggtatagtccttgaacaaataagcaacttttccgaggacatcaatcttccaaatcatcagaatacggatttttttctgaactgatgcaacgtgtaatgtagtagtcattttcctgtggccaatcttcatcgaggaaacctcggaccaccggttgggaagacctagattaggatctctgtgaaatcaagacttatattaatgtgcgtttttccgttctaggtatattgaaaatcctcgtattgttctgctggattgccccctggagtacaaaaagggtgaaagtcagacaaacgtggaaatcgttggcgatcaggatttcaccaagctgctgcaaatcgaggaagagcatgtggccaaggtttgcgcggacatcattgctgtcaagccggatgttgtcttcaccgagaagggcgtttcggatctggcccagcacttcctgttgaaggccggtatcaccgctatccggcgtctgcgtaagaccgataacaaccgagttgcccgcgcctgtggggctaccattgtgaatcgcacggaagaactcacggagaaggatgtcggaaccggtgccggtctgttcgagatcaagaaactgggagatgaatacttctgcttcgtgactcagtgcgctgatccaaaggcctgtaccattctgctgcgcggtgcttccaaggatgtgctgaacgaaacggaacgcaatcttcaggatgctttgcacgttgctcggaatctgatgctggaaccgagactgctgccaggtggtggtgcagttgagatggccgtttcgcaagcattgacgaacaagcaaatccagggaccataccgtgccgttgcccaagccttggaaatcattccacgcacgctggcccagaactgcggagcaaacacgatccgtacgctgacggcgctccgggcgaaacatgcctcgcacccggctggatccggtccgtgcacctggggaatcgatggcgaatctggacagattgtcgacatgaaggagaagggcatctgggaaccgctgtcggtgaagctgcaggtgtacaaaaccgctgtagaaactgccatcctgctgctgcgcatcgatgacatcgtgtccggatcgaagaagaaggccgatgacggcaccggtgccggtccggctcagatggcccaaggaatggagtaatcgagtagatttagcggttcttatgttaatcatccccataagtttactaataaaactgtcattcacttacctacacataaaaaatcacacctcttgcggggaatttcgttaattccctttaccgatataagttactcaataggttttccttcgaaggatacaaagaatcgtcgcgcatttcgtaaacgacaaaggccttgatttccttgaaccaggagcatccacactaaccatgcgataaaggagcgaaaattgcgctacaccgatgcttacaatgatctaataatgtcagagtgcacagtcagatgcgtttaaatcgtttcaataaacacgactcttttgctttaaaatcatataactggttgtacacagtgccttatttacaatatcacattctatccgagtgttatcgacaaggaagattcttatgattagaattgtataataatgatacctacctatttataataaaaccgagcctaaaagttgaaaacagatatccattacttggagcagtttgaagaagtaaacacagaggatgaggatgttagagccttcttcctccctacgagacgaggtcacggtcacatgcatggttcattgaatgtggggaacccttcagataaccttatttaattactctatagaagaaagaaacactagagtaaggtggggcaaaagttcgaccttagtggtataatcaaagtttccaggaaaaaatagcagttaaaacaaaacaaataccatacagtgaaccttcaacatattggctataattttgctgaacaaacttgtgtcaaaatatatacccatttttagttataacaattttaaaattgattgtcttattcgaacttttgccccaccggtggggcaagagttcgaatctagtgtggggcaaaagttcgctggctaaaacacaaaatatcgatccttttatgacaggcatactttacaa

SEQ ID NO: 166 - DNA, 15529 bp, Aedes aegypti
caaaacaaagcacagctggtgcctgcgattatcaccccgcaacaaaatgagcagttcaacttgaatgttgaagcagttcaacgcacgtggaaatgaaataaaacatgcttgtgtgctcaaatcaaaatgtccgatgttactataactgaaacattggaatgtccaatgtaacaattgttgaaacagaacgacctatgtgatttatcctatgtacatattttcggtcaaaacgtcctatctgatgtttttatagatttcagtgtaatttccaaacaaattgacaaaatttcatttcatacgttactctattacactgcttccctctacaagcaacacagtggggaaaaattgtttcattttgatacagtttcaaaatatattttcacacccttcaagctcgatttattcgaaatgtgtgaaatgttagataggccgttttgaaaaattgcgcgagtattgtcaataaatattttcttctttgccgacattcctttcgtatcatttttctccgacactcacttctcacaacgagctgaactccgacaccgtttcacgacccaaaagtcaaaacgaaatcaacaaactcatcgctgtcataacctcaaaccaaactatctgctcagcagaaaattctatatcaatccgtctgccgcaaaataaatccgtaaaaattgtaaaattggtgtgaaatacaattaaattttactcggttgtttgattattctcccccgcaaccatgtcccgaggaagtagcgccggtttcgatcgtcacattacgattttctccccggaaggtcgcctctatcaagttggtaagtgaagtgacgaagcaattcgattgtggaatcgggaatcatggaatatgttttcttcggcagaatacgccttcaaggcaatcaatcaggagggtctgacgtcgattgctctcaagggaaaagatgtggcagtggtggctacccagaagaaaatccccgacaagctgatcgatccgaccacggtgacccatttgtaccgtcttacgaagaacatcggatgcgtgatgactggccggatcgcggactcgaagtcccaggtgcagagggcccgttacgaggcggctaactggcgctacaagtacggatacgacatgccggtcgatgtgctctgccggaggatggccgacatttcgcaggtgtacacacagaacgccgaaatgagaccgctcgggtgcagtaagtattcccattctgatgcctgtcttgattggagtttccgcaatgtgggtctacttaaatgttatacctaggtatttctagtttgaagaataaggaaagaatccatattagcatatccaatagaataatgtatgttatacactggaatggtagcagttctctatttagagacttggtccctgtttaaatgcaagttactaaaaagctaaaaagtatacattttaatgaaaaatttctaatatctcctttttttttaacttggttttctctttgcagtgattcctgattcgaaaaacctaactaggaatttccacaacggatcactctgaaaatttaaaaaaatgttataccaggatttcctccagagattttcccttcaattcgctcatcgatttatagcagatgttccaaggattcctatagtagttcttccaagaaaatttaattccagagtttttgtagaaattgtctaagggattttccaggaactcctacaattattcatcaaggagttctcgcgcctattttatcagctaattcttcagttattttcatatgtacttattctttcattagttcatccatggttcatcttatgaattgctccaaaatttttccaagaaatctattaagaattcttaagagtccctaaaaatattcgaccttggattcatcattaggctccttcagaatttcatttatagacctataggaatttctccgacctttctcgagtcaatccaaaagggtacctcagaccgtagttttagggaaattctatctaaaaattgttcaccacagtaggtatcaattcctatttctcagaattaaaatcaatcaatgtgatttttagcacgttgagtgacggtttactataactatacgataaccatcgattttattctgagaacttccaaatgtaaaacaaaatgagttttaatgctcggaccttttttgattttcaaccaagcataggccattttttatgtaaacatgatttttgttaacgtgtttgggccctttctgttcgcttcgtatgaacaagtgagagtcattggcctgacagttcacgaatttttttcgattgtagcgtccagatggaattccatcagatttttttttaaagcttattgaacacctgctcattccaattcaatatgtgttcaacttttctttaactaatgctattttcccttttttaaataagtagctatgttcccggtttacattgcacattgcattaaggtacggttcgctctacctcggatgcaaataaccttcaacaagatctggataccatggaatggtgcattttaaacagaataatcgtcaatccagacaaatgatccgccatttccttttgcacaaattcgggatccagttatcttcgcataggggaaggggtggttaaatgaacaccttaaggatatcattttgtttctgatcgaaaaacaaggaatttgtacagttctatcgcacaacatctaaaatagaaatgttttctatagcagcgatacgaatttagactgaaatagctaaattttcacatatttttatcatttccagctctatgtgggtaaaatgaatagctgttggtggtaaaatgaacaccatgcaaaacaacgtgagcaaaacaaacatttttggaaatttgcattgcatatccgcaaatatatccattaaggattgtaacccattcgaaaagaaatttaaatgtatcaaatttgacatcatatcataccgatattcacctcactgaaaaaacctcttcgagctaaaagttacgtcagttttctacgtggttttctacaatcttagttttcgatgatatttttactgcaattgacctctgtattaacccaaacacttcgatgtatgccctaaaacgtccatgcgtgataaaaattcattgaaatgtgtttttccttcgtaaaaggcgcggtgttcattttaccacccctgttaattttgccatcacttcccctacaaaccgcatggaaccatgatttatcgtgttaactcggtgaaagttctgggagttgtgctggactctgaattgacgtttacaaaatgagatccaatcccgcatcttaccgttgaagggaaacaattgaccgattatgcgaacaaccttggcattattttccaatgtaacttgagttgggacaaagctgtatcaatccagtgtggaaaagtgtatgctggcctccgtactctgcgtgccactacgtcagacctgccttaaaacatcaagcttcagcttttcaagtccttgttgttaaaatacttcatcttcggcgatgtcgttcacctcggaatgagtatggccatgtttacgaatcttgaagtagcactaaatgactgttgccgctgcgtttataatatgaatcgttacacttctgttcgaaatctccaaagaaatcttcttagctgtccttttcgccgattttatgaaatgagagcatgtttgcagttctgtaaaatttttcatcgtagtgagccaatcttgaaagctgaagctgcttcaaggacgtcgttcactaaactttgttgttccgttatatcgtactgcaatatatgatgatgactcgttatttgcgagaggagtggtatattgagtgcgcaaccaaaggagctaaaacaaattcactcggaagaaatatataaaaaggctgcactggaatattttaacagagactagttttatttctcgttcaataaatgtttagtgttcgctggaacttaagttactacaatgtaaatatctataatggcacaaaaaagaagcgaaagcgtgaaacaatggacacgaatcggaacatggaacgtactaaccctagcccagcagggtaaactggcacaactcgccaacgaggcatgtcgcatgaagctcgagcttacgtcgcgcttatgaagtgggaacctataaataagagaataatcgtcgacatatttggagcatgggttcgaaaccttaccatagtccaatgttatgcgtcaaccgaagctgccgaattgcaggacaaagagaactattacagtcaacttaatgctgtcttagataagattccgaagggtgatatcaagatctacatgggcgacttcaatgtgaagatcggatccgacaactcgagctatgagttcgtcatgggacgccatggtctccggaataatcatagcgctgacatcgcatacaaccatcaccttctcatcggcgaggtgcgtctgcgcattgcgcggatttgtcgacaggagaaaagagttggacgtcgactggaagatgccacagtgaaaaggtccttcgaagaactggagaatcatggtgctattatttcggaaggtggcagcgtagaagagcaatggatctccatcaagaatgccttcaccactaccagcgaaaatcatctgggtgagctacgcactcggagaatacagtggatcgccgatgaaacctggaggaagatggagcagcggagagaagccaaagccgctatagagtgggcgaaaaccagaggagctaaggcacttttctgtcaatgatactcggctctagaaagggcgggacaaatgagcgtgggtggactcccttgctgacgaagttgcgaaagccgcagcaaccggcgtcattcgtctcctctacgatatctaacgacgcctttgcggagcaaagatgaatatgacaatgcctgtgaaagactggatggctggacagctgttaaccgaccccactgaccagctaaaacgctggtttgagcacttcgaacaagtttttcaagttctaacccggcctctccaatacctcagcatgatccgcctagggttcggcgtattagtcgcgtcaataccggagcttcatcactgcatgagatagaaacagccatccaaagtatgaaatctaacaaagtctctggggtcgatgacgatcgcgtatcagccgagatgctcaagcaatatccgctcaactgttgcatcaactgttccgcaatatctgggacatcgcgacttttccggccgactggaggcaaggcgtgttagtgaaggtacccaaaaagggcgacctcactgtatgcgataattggcggggcaccatgttgctatctattggtctcaaagttctgtgcaaagtgatcctaaaccggattcaggagaagatcgatgcgactctccgtcctgtgtggaccatattgtcacgctccgtatcatcttggagcaagtcaatgaatcccaagtgtctctgtgtatggtactcattgactacgaaaaagctttttaccgactcaatcacaaaaatatgtggagtgccaaagtgttttttttatagtagggtacaaaaaagcttcaacagcctggcctgttgtgtgttggcacggtgtgggactcacgttagacgtgcttaaccactaaaaaacattccctactgctcctgtgcctcgatcccccccggaactacatcaggcaacttcatcgggggagggctgtgctcatgcacttcgtcaatctcagcctctagctgttctgctagttcgctgttggagcttaatgtcgtcaaaaacgcagatcaatacgacatttctacggtgtctctgcgactactcgttttgctcaattggcggttgaagatctcgccgtgcgggatttggacagctttctgtgcgacgacgcatacttcccttgggctggcctcgcgtcagagtcctgttgaacctcttctggacactcatgtgcacttcgttgctctacgacgactcgttcaccgctgctgctgttcgagctctcctggttgaccagttggatgccgaggtcggtccagcgattccggttggaggatgagttccggttcactggcgccccgacgacccaaaactggtttgtgacgatcgatgctactcggcctagtccccgacggtggagctagcctactccgactatgcgcttcttcatgcttcgatactggccggtggagtgccgaagtcggtccagcgattccggttggaggatggcttccggtttactggcgctccgacgactcaagccgttattcccctgttcaccgcattccaggtgctttcatgctgttacatgttctgcacgatgttgtccggatctaggacgcttgcggtttctggcatcatctcgcttcgtatatccctgaatcgagggcagtcgaatataacatgctccggtgtctcctcgatatttggacaggccggacaatgtggagattctgcgtgtccgaatctgtgcagatatttccggaagcatccatggcctgacaggctcctccgcagtctcaccagttatcgcaagaacgacgtcatctgcgaacccgacggtctagactccattcggcagtgacaaggttagcatttcatcatacatcatgttccacaatgttggaccaagtatgaatccctgtggaatcccgccgtgacttcaattgacatccgtccctggtttgtgtcgtagaccagtacccggttctgaaagtaactttgcagaactttacacagatatccgggaacccgcattctgtgtagggctgcggcgatagcctcccaactggcactgttgaacgcgttcttgacatctattgttaccactgcgcagtatcgattgcctctcctcttctgctttctccacacacgcgatgactgcccgaatagcatccaccgtcgaagtctttttacggaatccgaactgccttttcgacaatctgttctcgccttccgtgtagatcgtcagcctgccgaggatggtcttctccagaagtttgccaagagtatccagcaagcatattgggctatatgaagccggatttcctggcggttttggcagtaacaccagcttctgcaccttccatctgtctgggaagcagccttccgctagacacttctgcaacgctgtgctgaatatgtctgggaacgccaagattgctgcccttagcgctacattagggataccatctggtccgggagctttgttcagcttcaatcctttcgcaaccgttatcagatcggcgttagacacttgtataccggcattttcttcctctacgtcagcgtacagtgtgggcggctacgcggttggggcatgcgtacgaaagagaccgttcactatcgccttctgtttgtcgggacacatttcagctggggtaactgggcccttgatcttcgccatcactactcgataggcgttgccccgtcagcttcccggcacaactccttgtagcagttcgttttactcgtcgctatttcccgtttgaacgcggctctggccagtcggtaggtcactttacgttcttccatgctggcttcggagctagctctctgcacgcgtcttctggctcttaagcaggctgcgcgaaggatgctgagtctgtctttccaccagtatgcaggacgccgttgatttcttggctccaattctctcggcatagttaagtcacacgctctcgccaacgcttttgtcagctctcctgcattcatgtttggagcatcgcttactgctcgaagtgcttcgacgaaaagatccttatcgcccaccttcgttcccattcctcctctgccatactgcacaacttctctggccaacgcagtagtggatcgctcgatgggcactgtgggtgtattcttcgctaactctccagttcatattggtgatcagcgacgggctgcaaaaggtcatgtcgatgatggattccctaccgtctttgcgaaatgtgctagcgagaccgtcgttgcacagtcttacgtcgagctttgctagagcttccagcaaactgtatcctctcgcgttggttagtctgctaccccactccacggcccaagcattgaagtctcctccgattattaccggcgttcgaccgatcatcagcttgtcggttagcacatccaacatctgagtgtactgctccagtgtccacctcgggggggcgtaacagctacacacgacgattccgttaattttaacgatcacgaaaccctcgtatgagcgttcgactacttcttggatagggaatcggcccattacttggatcgccgtcgtctctgctctgtctgctacccaattgccgttatcgagaggaacccgatacggttctgcaatgatcgcaatgtcgcactttgtttctgttgtcgactgccacaacagttgttgtgcggcgtcgcaatgattaaggttcacctgcgttatcttcatcatcattactgccctgccttcgccttctgatttggggcacttgaagccacccgccgtatgggcgttaccttcctccaccttacacaacatgcacctaggtgtcttcaggcagtccctgccaacgtgagctttttcaccacatttcctgcagtgttcggatctgtccgggcctttgcaatttattgcccggtggccgaaatccatgcatttgaagcatctctccatcgaatttgtctcccgagggatcagtttcagcgggcaaaccgaccatcccaccaaagacaaattaaagacccccatgtcccttgcagttgcccaaaattttatggctcgtaaggtaatctagaatgtcgttcaaagtgtactgcgatctgtcaaacttgggtaccttttgcactaccgagggaccgaatgcagtactagaagtggtacccaacctgagcccgattgggacggacctgatcccaccttgatcttaggcggcatccacaaattacgtaacgctctaggggaggggggagtagactcaagcgttacggctcatacaaaaattaaaaaaaaatcatacaaaaagcgttacggagggggggggggttcaaaaatttccaattttagcgttacgtaataaatggacgccgccttaccagcctcgtcgagttttttggctgcacccctcacgtcgtcctctgttgtgatctcgtccagttctctacattctactgcctcctgggataagactctaatgcttgcctcgttgcccagcgacttcgcgacgagctctcggcaggccgaactcttgattgacggatcttttttgagctcaaatagcatgtcacctttctgggtgcgcctggttctcaccacgttttcacctacatccttcagctctggatcctccctcactctcctgagaatcgccgcgtagcttgtcttgtcgcttgcctcaatgacaagagcatcgcccctgaacctctcgcgaggtgaccgtcgcttttctttcttcttcggttcttttttttgccgcttcctctccttacgtgctgtattcttctccttttgacttttcacggtgcgccattcagtgccgttctgctcgctgacgcactcattgtcgcttctctgatatttgcgagctgttaaaactttcgggtcgaaaacgaccctaagtcacaatttgtaacttcttgttagggactaaggaaggttgaatgacctcaatttggctgatgatattgctatcctagctcaacggtgctctgttatgcagagtgagctcgatgatcttgccgaacgctccttagcggcaggtctcaacatcaacgtcaacaagaccaaatcgttggatataaacacggtcagcccttcccgctttacagtagccgggcaaaatgggagaacgtcgaaaacttccaatatcttggtagccaattggcgtctgacggcgttaccaagatcgacatagatgcacggatcaagaaggctgcttttgcgagcttaagaaatatttggaagaacagtcagattagtcaacgcaccaaaatacgaatattcaattccaacgtcaaatctgtgctggtatgcaattgagttgcttcttataatcaatcctcatattctgaagaagtattgggaccttttcgtgttccaacaaaggaacactcattgtcccaaaatactcttccataccgtggtaaaactgaaggaaggtttcattacgtgcttgttgacgctgataagccttcatttttattaaggtgtctaggtcagggtgcataaacgtccgcctgagctctagcatcaaatactgccagttgactaaccggcctgtagagcgcatggtcatgtaccattgcagtgctggaactttgaaatggtgaatcgctgaatcaaacagttcagcttccgaagcatgttcagcaacagccatcgcatgaaccattccaatggactggttcaacttcagcccttgatcttggtgtgacgcacctgattgccagacggaactagattaaaaggaacgcaattagatgaaggaaaggcagttgaagttgaagctgaactccctgtaggtttgctccatgaataagccggctgaatgatgcttggaatcggattccctagccacggatttgaagtctgcccactattcaaggccgaagcccctagggtcggatttgaaaatggtacagaacctgcagctgaaaaccctagccacggattggtgacttgcgggtgaatggaaggattgttctgcagatagctatgccaagttgaaggaggcgctgcggctgtgcagagagatggctttgtgataacgagaaggttacgctagtgatcggcctagaaggatcaaccgcccccgaagaactctaaccctgtcaaagtaaagaggaatgaagagttggaggagcttgactagtcagcggcgcactcactactggctgccgacttccactaggaagctcggattgtctgcgttgagacttttcctcgcactgtcgtcccattgtagccatctccgcttctaactctttaatgtgagctggtgaagagcgcacacagtcactgccgtcaaaccgggaagccaccgaagtattttctgaagtagtattcacaccagaaactactgtacctgaatctgcaatcgatcacatcaaatctattttcattcccgctcgtccggggaaactgtctaccactccactgacggagcaaaaaattgagctcgtcgaagaatggcggaaaaagcctccggttagacagttcccgtatgtcatgtctccaaaaacacaatatttggtgtccgtagagctgcaaagactgctcgacgcaggtatcatcgaacacagttactctgattggtcactaaactgtgtaccagtcgtcagacctcataaggttcggcactgtttgaatgcgcgcaagattaatgaaagaactgttcgtgatgcttaccctttgccgcacccctgccgaatcttaggccaaattccaaaagcgaagtcggcagatgagccggcacattcaatgcggagatgcgatacaagtatcacgtgtgccgaagtgccgagtgggagtccgcggctacaaagcacagccatgctgaaagtatctgggttcgattcgcggtcggtccaggatcttttcgtaatggaaacttccttgacttccctgggcatagtgtatcatcgtacctgccacacgatctacaaatgctaaaaatggcaactttggcaaagaaagctctcagttagtaactgtggaagcgctcataagaatactaagctgagaagcaggctttgtcccagtcaggacattaatgccaagaagaagaagaaggtcaaagtctcgcatttagtatcgtacaggcgtatcagcagtgatcgatttctcttggtcgattttctcttttgattagtacacgacattcaaaagattttcataacattttacgatgcaacatgacgaaggatgaagtattttctattcaataaaaaaaagcagtcaaaaactgttgcctgatcaagttataagctaaagagaaaatcgataaagagaaatcgatcattgcactatggtccaggaatcagttttacgcggaaagatgcattttgagctttagaatgaaacattagacaaaaacggtcttctacaaagttgtttgtattagttaagccctttgtttggtgttattgaaaattagggtggaccacattttcatagaaattgtgtaactagttttcttatttgtagaaattatattatacatgcttcagcaaagttatagaccgttcaatttcaagcaactttgccaaaaaaagtttttttgtatctcttatattgaccgatttagagcttttttcctgcagtgacatagggtggtccgaacaaaactggttttctggctctagagttttcaattcaaatttctcatcaaagtagtctatgaaacacttttagagctttaaaaaatgcgtaatttggtgagtgaagaaactcgctatctccttccgtttaggagttattgttgtttttctctcaaaaatatgcctactttgattgtaaatatctctgattggggcaaacataaaaaatatcttttgacggaattcaaaagacaaaataaaattgtatattatatcaaaaaattacagatgtgttatttttgtaactctaataaaatgccttaaaaatcaaaggattttaagcagaaaaactttaataacttttgaactaaaatagatatcatcaatatttttgcatgaaattttgcgttttgttaagttcttaaagtcgtccatggaccgctttgacgagaaatctgaaataagaaagatagggctctaaaactattttgaagattttcatagaatgtatttctttattattttgcattttgagcatgaaaatgaaattttagacaaaaatgaccttatacaaaattgtttctaaaaatgtaagctttcatactgtgtcatttgaaattagggtggtccacaatatcacacatataatataatcaacttttttatttgcaaaaatactggtatatgtcaaaatatattttttatgtttgccccaatcagagatattcacaatcaaagtaggcatgttttttagagaaaaacaacaataactcctaaacggaaggagatagcgagtttcttcactcaccaaattacgcattttttaaagctctaaaagtgtttcatagactactttgatgagaaatttgaattgaaaactctagagccagaaaaccagttttgttcggatcaccctatgtcactgcaggaaaaaagctctaaatcggtcaatttaagagatacaaaaaaactttttttggcaaagttgcttgaaattgaatggtctataactttgctgaagcatgtataatataatttccacaaataagaaagttagtttcacaatttctatgaaaatgtggtccaccctaattttcaataacaccaaacaaagggcttaactaatacaaacaactttgtagaagaccgtttttgtctaatgtttcattctaaagctcaaaatgcatctttccgcgtaaaactgattcctggaccactgtgcattgcagttacatcttatgatactaagcgcgaagtctctaaaaagagacccgctaccagacctgaaattgacaatttgattgtttcaacattttaaattgaaagtcgcaaagttcctcacagaacaacccaagaagctttttaatagcggcgcagccaaaattttttgggggcatttgacgcgaaaatcctttgtcatgaacatattctatgatgaattagtgcctcaggaaattttgcatgattgttagggatggtacacaaattatgtcgcgttaaatttaaacttttttgtcacgttttttgtatgagtcctccgaaatttttgtaaggcttgtcacgcttggcttgaccccctcggagcgtgacataatttgtgcattccctgataattccagattttttcaggtagtagtcctgaaaaaggagaaaagttcgaaccattcgaaaaatatagacatgcattaaaattatgacctgaagtataaaaacagacttgctaccagtcctgggacaattactttttatgtgacctcatcctgcctcgatttagcctgctaacgacgtttctcaaccaaaattctaattctacactcatccctccccatctaggcatggttctgattgcgtacgacgatgaaaacggcccctgtgtgtacaaaaccgatccggccgggtactactgcggctaccgggccatttccgtcggtgtcaagcaaaccgaggccaacagttatctggagaagaagctgaagaagaagaccgacttcaacgagaaggaagccatccagatggccatcacctgtctgtccaccgtgctggccgtggacttcaaaccgtcggagatcgaactgggcgtagttagcaaggataatcccgagttccggacgctcaccgaggacgaaatcgaagttcatctgaacgcaatcgccgagagggaataatcattcacacacgttttacgtaccgtcttcaattattcagtttattctccaattcaatgggatggaaatacacatttattaaaagtatatgcggagtagagttaatccttaatctaagtgtctctagaattactttccggcagcggtggcttgtggattccgaagtaccaaaatcaccgaatcgcctcgcaaaaacatcttcgagataaagcgatccttgttcactggtttcaccttcttcttgcccttgccagtgcgaggcacttcggtccacatttccttcacattctccaggaccatgttgcagtgccgatcgaaggctttgactcgtcccagcagttttttgttgttgcggcagtttatgagaacctgagtattgttcttgactgattgggtcaggaccgagagcggaccggtgttgaattcctcctcctcttggcgggccagctcctccggggtcagctcggattttggtttagcgagggccctgttgaaattggaagtttggttagaatcggatcgtcatcccatcgagaggtgttttacttacattctaatgacgaagcgaacaaaattatgttttgaaagatagagcaaactttgagtttttcaaatcacttaagcgtttaatgaattttgttgtaattcactgtaataagaaaaaaattatttgagccgccgcttatgacgctagaaaacgtcgaacgcacgaatgttttgatttttgtcagattcgcgaatgatgacagttgagacaagagaccaaaactgacagtcatcatttgatgattgtcggagtaaatcagccttctttatcgactgaaacgaggggtgtaaggaatcgcaatttattttgcgttgaaattctacacgctaagatcagtctacccaaatatgggtaaagtttacccataatcgccgaaaagtgcacacactcattttatgggtaaacgagctttactcataaattggtaaagtctctctacccataaatgggtaatttatttttatttggaaattcgtgattttcacttttttagagctagaatatttttaatacggttttgtagtttattataaatgaata

SEQ ID NO: 167 - DNA, 27906 bp, Aedes aegypti
cttcattcatagactctggttcggggtagggcaaaccggttttttttcgttcgttttacctttgcaagacgttgagccactgaaccgttcaaaagatccgatttactaaaatgagtgattcggatcggatccgttcactaaaatgagccgttttgcccatctctaatgagaaccatgaacaagtttttaaatttactattccaatcacgattgagctatcaaaagcgctttttatttgcgttttggtccctctcgatccaaccgcatcgatagctgagcggtaagggttcgggcttgacaatcgcaagatcctcggttcgattctggcttgctgcaagtttttaaccatgatatagtcatttttactgtcgaaatggtaccatggtaaaattgaatgcacaaactatttgaaataaatacaaatttagtctgcacaaatcaagtggcgttgtgtatttaatttaaccctctaacatagtattttcaactgcaacgctgttctcagtgtataagtcatttcatgaatttcattctctgagtagctgtgtgtggcacttgacgcccttattctagcacatgcttgataccaaaaaaagctattaaattccatattttttccgccgggatctcacgcaacgtcaacatggcaaaagtcatcgccgactgactgggtaggtactaaaaatggtactaaattcgaggtctgtacacgtattctggttgtcatgaagtgcaaagataatttggaaaaataatttacgaaatttggacttgaaatttatagtttattacgggtaagttgtcgtcggttcaaagtggaaagtgcagcgatcacaataagttaaaaatcggtctgtttgcgacccgatttaaaggctaaatcatcgattgaaaatcgtgccgtgggcgagagagcaaaaagtggaagaaagttagggtgccctctgtgcttcgtaaagcattctgtgttttcttcgtggaagaacaccgaccaaaagctggaatttcttgattcgtaatggatatctttttgtcttaggaatatttgcgaatataagcatcaaaaatgtcgctgtcggaagcatcttgctacaccatcatcaatgctcaggaaacggagccatacaatgagatgcagctcaagttggatcttggtaagataagagtgaataatcagggtggccacccagtcgggatttttgtgaaaatcgggaatattggtagtccaccgaaggaattttgatcttagcccgaaaatgtaaacaaatgtccaaaatgtaaacaaatcgattgtctgctggtttttgcatatgaaagactaatcactaaaaaaaattaattgaccacaaaaagatactaaagtattttttccaagaaacttttttttcacgaaaatggttactattttcggtccctgatgataaaaaaaaaacaaatatatggatgagctatttaaacttaaagagcaagacattaaccctttctttcccacgacgttttttgtagttaaaaaatagaaaatttgatatctggataaattaccagaacaaaagatgtaaagttttactcaaatattcgaatgaaactaaaaaaaaatagatcatttttatgatggatcacctgtgatccattgggaagataactgcaactagagtaaaaaagagaaatcaattttgtttctgtttatattttcatttttacgcaaaatcattctttttatatgtaagttgtgctcttctcgcctctcgtcggtttaatctggtggcaaatgaaaggctgtgaagcagtttttgcctttcttgatgcacaagcaaacatcacatttagtgcatttaaggtgaaactcctttgaatccactaataactgtataaaagtagtggtacacaacaaatattctcctatttgttggtaatagtgaaattataattgataagatgttgttgccagtaatcgctacttcaatttgagtcttttccccttcgactaaataagattgcttgatgtcgtacgtaagcatcaacgtatctgacagccctgcaagcgagaagccggtgtggaattagaaaaaaaaaagcgaaatgctgtgatcaagtgattgtttttagcacggtttgatgaatttttaagttgttttcatcagaaatccaccagtaactgttctgtaattaacaagtagtgaaagtaaactgtgttggaggttctacgtttagtgaaagtggtaaaattcggcgaaaagtgttcttcgttcgcaggcggataagtgtaaacaattgtagcaaagttaaacgtccgcgttggaaattagcacggttcatgaaatttccaccagctactagtgttaaaactacggaaatcgtgaggcaatagtgttctgatgtctcgttagcaatttgggtgtgaacttagtgtaggtaagtgaaatattttgagaaataatgtggacttccagaaatgtgtttgtatttgtgaggaagcaattttcactgccatgacagggattccttcctatatgtccttaaatgaactgaatgatcctcgatctttgcacagaacgcaacgttctcgacggtcttcaacgggccaatgctctagtccatcataccgtgcttctagagacggcccaacagatgctacttctcgctgacgtttttgtataggttggtttgttggtcgtcttcggcgttttacaattttctttccatattgaatcagactgttggcaacatctattcggaaattgagaagagtcatatgttcctgtcccgtttgtttcatgtggcgcatatacaacaaccaggcattcacaacagatacatccagtaaatgataaaaaattctcatgtagtatttcttggtgcctggttgtgttctgtatatagcaaccaagaaatcattcagatcgatgcctcccatgtagcagttgtattcccgaacaactagaggtcgtgggatacttttataagttttatctgatacagaccaacgctttacttcatctatccactgaaactaatgctgtagtaacttaaaccataccattgttgttaacgcaactattttcaattattgttaatttgaatgaatttgtttcaattataaaaacaatgttattgaaattaccatgttgcaataccacaatactgtgtattttcaactatgttgttatagtcgaaaatcattctttcttaagttaaactgactacccgtttagtaatgaataacggaaggtgttctcgattttaccatgcccatggtaggaataagaattaaaagaatgtaattctcaccagcgctcacttacgtttcgagctcactttcattatgacgccattttttttgtgcaccagtcaagcctggaccttgcttagttgtgtggttcgcttcaaaatgtattaattaaatcaaacaataaaggagaaaagtagctaaatagaaaaaaataaaatagcagaaatgtaattatatagaaatagaagttcttgttttcaaatgtttaagattcagacctgcgaaatggtgcgtataatctaaatttgagttggatataaagtaatactcatttatatttttagcccgggctgagaatctagagttcctcataccaaaattcagagctgccaagactcgagtcgcgcaatgtatagcagagaaataccacccaaacctgctgtaattgcttctattttatatcacagcataatttattttcttataagctcactcatttacaggagtgtactttgacctacgtatcgagcaatgagaacctccacccggatttctttataaacgatgccacaggaaagcggaagagtttacagaagctgtcatgcatatcgtcactacttttgttttgcttccaaaattcaacgacgaattcttcgatctaaataatgataaggtattttttaagtgaaaattatcgaactaaataaaaaataatatcttgcaaatatatattgactctattcaaggtatgcacatttgcatttagattggaataccgataaatctaaatgcattatgcgtggaccttaatgaattaataatatccaataatacaagccgctagatatattaactactcggcattctttattttaaatccaattaatggttgaatattccacttcgaattctatttatcgttaccacgtctaatagtgaaatttactacatgattgtcgttgctttgaatgcaagagatggttgaaagattaacttttcttggttttcaacataaccatggaacatggtaattttcactgcttacctcttatttcgccagcattgttaaaaagacgacaaattgtgattgaaatgaatgcagtgggtagtctgcacaaaagaagtggtgctgtgcatttattttaaactatcaacatggtaatttttaccgcaatgctgttttcagtgtcggctgcactccgatcgatcggctgcaggatgatataagattaatcggcttattgtccatccacgttacaacgacaatgttgtcattggacacattgcatgcaaatgagcctctgccttcagctttcaaattctttttcatttcgaatcctggaatcctgttttgtcttacggttcctgtgtactccagtccacgagatttcatctcttttactaatgcatacgacgaaaaccagttatccgcaaaaattcgatacggaacgttctgtggtaatgtgtcaatcagcttgattataacatcgccacttatgccccatgcgcctgagagttcgttgtttgttttgccgcagtaaatagaaaaatcgtgcaaaattccatcggaacttgctcgtccttctacttttataccaaatcggtgaggtttgtttttattatattgtcgtagaggagatgctgcttttgaaggtatcatgatctcgtctatcgattgattaggtgtaggttcaattttcaaaaaattacgccggagagcatcgatgaacgggcgtaccttgaacaacttatcgtatccttcttcatctcgctgcttgattttttgtgttgtcgttgaaatgcaagcaccgtttgatggtctcaaacttgttccgtggcattacatcagcaatcggggcatatctggtagtagaaccccaatgcaatcgatacgatggcaccttcgttacacccataagcagtagctgtccaatatgctgctcgatatctcctgaagttacatcgattggggtttcatcctgctgacttgaataaagatttgtttgttcacagatatcagaaataatttcagaatctatgaacaacccgaagtactggtaagcagtgttgatagactcacactcaaaatctcaatcaatacgctctcccgtgagagcaaactcattagagatctgcttcgcaaatctcgcaaatctcacgcttgagattttgatgcaaaatcaactcaatcaactcaaaccgtgaaaaatgattcagtcgcaaaacctggcaaaaactcgtggaacccgaatgttgtagtttacgttagaaaggattaacataatattaccagactaacaagaaattattgccgtgtatgagtaaactgtggatatacgagacaatgagttaaaacggtgagccaactcatccataattttttgactgctgagttgcatgattgataactcacgcatgaaaaatctcaagcgtgagttgtgagaaattgagtttttcacaacactgctggtaaggagtcattggcttggtcggtggtttagaggattttacaaccggttcaatgcaatcgaaacaaacactttcatcctcatgccacttaggtggagtgcccttctttttggatttcgatctagtagaaacccccctttttctttccttgctggttggatgcagcttgcttttgctgatgaatgttgttgggttacgacgaacttttgtcccggtatatgactagttgtatccttctgtggcttcgtacagctttggggattccatgcagatggaaggcttcaatttcatcttcatcgtccgatacatcgattccttcaacttcagatacgtctccctcaaaggtcaatgcaagcaaatcaagatcatcagtatctgtgaaatgaatcattatttatattatagatttgtaataaatcaatttttgatatactaccatcccactcatccagctctgttgtagttttcggttttaatttagaaaaatcatatgtttcatcacgatcttcgaacaaatcttcagaactactatcgtcatcgcagttatcggtttcaatcattgattgctgcatcggcagtttcaagagatgtgcgaagtcggctcgttccggtttcaataattttctccggttcgctaagttcttcaagcacggaagtatctccctcgaattttattggcttattgttgcaatctacaaatacctgtattattagcgattgataaaaattttaaaaactcaaatactaccatcgctcccagcaaccagcggaatcggatcatcactgggtacttgttcgtgttcgtacgaagtatcttcgaacggaacattctttatttcttcaccttctcggtatatacggtggattgttccacagggcatcctttcggtccattttgtaggaagattggtgtcggaagataatttactcttgcggcggcgtttcaatttcagtccagaagcatcctcctcgtctgtgatacccggaaatatttcatcatctgcttcaaatccgaagaaatcctcttcatccgtgagtgtagccttttctggttcattcgtttccattttagcgtccataaacaattattgtttcattaaaaatcacttttcacttaaaacacgttcgaaacgaggaacttagaacaactttctgagacgtaaacaaatgtgatgacagtttcgttttcagaaagataggttagaatagaatcgatgaaaatctcgttttgttcccaatggatcatcagtgatccacatcgttttcctcaaaatcaatagttttgtgtaaagattattataaaaactttattgaatcttggaaaaataactaaatcgagcttgttcttatttttgttaggtgaaaattatgttcatattactcaatatggatgtttgaaaatccactttatttaaatttgaaaaaatgccgactttacttcagtcgttatgctttaaattgaaatccaagtgtctatttctagtgaaactttgtacagtagttcatgaaacatatgtgaacatgtggtgaaaaaatgggtatgatctaacttgtccagtttgtatacgacctatgcaaagtggtggatcacctgtgctaccatgggaaggaaagggttaaaaatcacgctggatttaatcccaggtctcctgtcaattgacgccgtttcggcgatcagctgttccgaaacgtctcgtaaaatggcttataagccattttacgaagcctggtcaaatgacaggagacctgggatttttcaatcatcggcgtcagtttttgcgatgatgatggttgatgactgtgcgcatttcttgcgtaccttttcatccaggcaaaaacttaaatggagaaaaaatattaaaatatttctgatcacaaaagtgcttttttatgtaacaaagaggtagctgatacaataactaggtgtaatgttgcagtaacgaacatttgtggatctcatttttgtcattgtcttcatgtcctcgtttggtaagatgaggcgttattgaaaatcacgctggatttaatcccaggtctcctgtcaattgacgccgttgcggcgatcagctgttccgaaacgttttgtaaaatggctcattgcttgttctgaagttccccctcacagtgtccggccgtttggtcgaacgccgtttggccgaacgccattcaaaataatcaaattgtttcaacgcttatgagtatagttcataagtgtggctcaatagctgatcagctaatattttttttttttttgatttatatgatgtgtaccgaacgacatgtttgtcgctttattagtgctccaagagaataattaaaacgacccgttaattcaggacgaagttatgaactcgcgtcaagactctaagctaatggttggttcgtttctgagttaccaacggtatactagggtttgaagtgattttcatcagaaatttttccttcctttaaacattggctattgtttcgatttatactggttgcatagatactggcaataattaagcttattcttgattgtaaattttaccttctttaaatcattggcaattctttgtagttatactgatacagtaatgacccgattttgtcagcccccggttttgtctacctccgattatatctacccccgatttaagcaccctttttgacccgattttgtctacccaggtttttagcatcctttttgcccgattttgtcagcctaaaattaatacagtgaaacctccatgagtcgatattgaagggaccatcaactcatgcaaatatcgagcaatggaacagcaatcctttggaaagctgcttctagggaccatcatagtaaccatgaaattttctttttagtatggttccatgagtcgatatcgagtcatggaacatcgactcatggaggtatcactgtatttattttaattctatactgcacgctatgtctgaaccagacaattataaaaatcgaatgtacatcggattttttctcgcaagagatcagtatttggtctatattttcaaaatcggaaggttttaaaatattctatcggtgaattttttctcatacattttgtatgggcggaaatgtgtcgaaaacgtgattttcgagggatttagtatgaaaaatggctaaaaaacaatgtctatttaaaaaaaaaaatcataaaactaagtccgtaagttaaaataaaactcgaaacccaacgaaaaaaaatttcccgattttagctcttttccgattttgtcaaccataaatgcagcatggggctgacaaaatcgggacattactgtattatcattatttgcattatatatttgaatatttttcgttattggaattatggattataatacgctcacaaagagtcttattaaaaaacttttttttagcgcaagggttaacttaactgagatgttattgttctccaagattaattctcactgtttttccgttgtgaaaagaagaagtttaaactcgtggttgctggaactatgaattaatttacttagtacgattcgaagcatcaaagcaaatcgatgttacagaagaacgaataagtcgtgaaccgttttatttactgtcataagctgactacaaatgcaatgcaaaaacctctgctggcagctatgaccgcaagcagaagagtggaatacacttagattgttttcacgagctcggctgtgcgaatctctgtttcccgattttaaccgagactcagctaacaatttgtccgattgcttagcaacgaagcacgatttactgatactcggcttttatttactgggatcccaggaaatttgtttgccgacttctcggctgtgcggatctcggttaaaattagccgagattcggcattctaatttaagtgtgaacaattgcttaaattaaggattttcttatttcaccattgcatgccaactgaagttcactattgttttcaatttcggaattcggccaaatggccattcggtcaaatgaccctttcggccaaatggcgttcggccaaacggcacttggtcaaatggcattcggccaaacggcattcggtcaaatagcattcggccaaatgacccggaaccccactcacagtcacgaactaaactagtcatagcctaactcgatctgaactgcccataactgcaaaacagtcacattcgacatttttgacaaaatggagttaataccatggagagtcatcaaatgataaatactttcgattaacttactgaaatctgtgagattgttctagaaaattcgaaaaaaataccaagttgttttgtcacattggtaattataactgcataacagtcacattgagattataaatgggcctcgtaatgtgatagcaatgaaatttatatcagaactattttctgacaattcacctagtatgcgatatgagttgtacaaaatctcagcctaaaataaacacttttgagatcctggtaatttttagaaattttggtttcctaccatactgccataaaatgcacacttggtattccatttactcaatgcctacttttgtcgaatgttacaaatatgcagttatgggcagtgaattacatgaacgaatcgttctgatcctgaattacatgaacgaatcgttgtatctccttcgactttacgtctatgacttcagattcttctggtgtaggataagcagactgcatcttatgcgatttcttcatttttttcaccactactcagtctccgatggtaatttgactttttgtagcagcatagactttctcaactatttacaaaatctaaggtttactttgcctctaagagttactcatactttatcaatttaaaataaatacataatacaattttttgagaccaagcgattttttgttgttcaatttatcgcaactctataaagtatgaaagtttaaaaactagtagtatttgtagttggggccttctttagccgagtggttagagtccgcggctacaaagcaaaccatgctgaaggtgtcttggttcgattcccggtccgtccaggatcttttcgtaatggaaatttccttgaccctcctgggcatagagtatcatcgtacctgctacacgatatacgaatgcgaaaatggcaactatggcaaagaaaattttcagttactaactgtggaagtacttttagaactctacgctgagtagccggctctgtcccagttgggacgttaatgccaaacagaagaaggagtatttaaaatttatttattttgaaatcaggtcacatcatgtttcgaatagcaaaatttggcaaaaatctcaaatctaggaattttgaataaatcctgaaattaatcataacttcacgagtttattgaggaaaactataacgtttcctaatcaactttcttaaatagcaattaaatccaatataaatattatcaaaaaaaaagcgcgttttaagaatttcattcgaacaaaaaacatctgttttctctatcccgaccgagaccgagatcgaaaaccgggaaatactctagagcttcctttctacttttgagtagccatcctgatttatgtagaaccgtattatgcatgcattaatatctcattctgtttcagaaaagggcgagttgaatgtgaaaattgataccctgaaaagagtaatccagcttctgttgaatggtgaacgtctgccgagtttgctgatgaccatcatccgattcgtgcttccgttgcagaaccatacgatcaagaagctgctgctgatctattgggaaatcgtcccgaagacttctcccgatggcaagctgctacaggagatgattctggtatgcgacgcctatcggaaggacctccagcatcccaacgagtttctccgaggatctacattgcggtttttgtgcaaactgaaagagccggaacttttggaacccctgatgccggctatccgggcttgtctggagcatcgccattcgtatgtcagacggaatgccgtgcttgctattttcaccatctacaaaaacttcgaatggctggttcctgacgggccggaattgattgccaactttttggatacccagcaggatatgtcctgcaagcgaaatgctttcctcatgttgctgcatgccgatcaggagagggctttgaactatttggcctcgtgtctggatcaggtgaacaatttcggtgacatcttgcaattggtcatcgtggagctcatctacaaagtgtgtcatgccaatccggccgaaagatctcgctttattcgatgcatttacaatttgctgaattcttcttcgaatgcggttcgttacgaagcagctggaacactggtcacgctttcaacggcaccgacagccatcaaagctgccgtcagctgttatatcgagttgattatcaaggaaagcgataacaatgtaaagctgattgtacttgaccgcctaatcgcattgaaggaaaacgaaaacatggagcgagttatgcaggaattggtaatggacatcctccgagttttgtctgcaactgatattgaagtccgtcgtaaaacgcttactcttgccatggagctagtttcgtcaagaaacatagaagaaatggtgttggttctgaagaaggaggtttccaagacacacaatatcgaacacgaagacacgggaaagtatcgccagctgttggttagaactcttcatagttgctgcatcaaattccccgatgtcgccgccaccgttattcccgtactggtggaattcctttccgattccaatgagctagctgccgcggatgttctgattttcgtacgggaagccattcaaaagttcccacatcttcaggaactcgttatcgaaaagctactggaagctttcccggctatcaagtcttcgaaaattcaacgggccgccctctggatcctgggagagtatgccacctctgcaaaggacattatggatgtgattgccattgtcaatcaaacactgggtgaggtgcccattgttgaagccgagcagagaaggctggcaggcgatgagagcgaaaacgatgaaaataagactccgaatgctggcgctgttccgaacaataaggtcacctcggatggaacgtacgctacgcagagcgctttcagtgttgctccgtgagtattttttgatcttgtaacatacctctgtaaactttttctccgaaaaatgtttgccagtttttcacttcccagaataaaccgtttcccagataagtatttacagagctggtaatagatctctttttaatggcatctttatgaaaattcctgtttctggaaggaaagaaccactagatgaatccctgaggaactacgaattgtacagtcatcaatgcatatgcttattcttactcttactctgcggcatatgatttcatatacactaaagtctttttttacacggttttttttgcacgctttatttttacacggcttttttacacgcctttcggaattaacacggtactttttttgcacaaaattcggaaataacacggttttttttacttatttacacggatttcggaattaacacggcttttttttcctattcacatggatttcagaattaacacggtactttttccacggattctagaattaccacggtttattttaacacaaattccagaattagcacggtttttttttgcacggaatttttttgcacggcacgggggaccgtgtaaaaaaaaccttagtgtacattgtaacttaacagtatgactcgattctatagttgtttattaaaacatgtttatattttatacttgaatgagcggtgatctgatgcagtgatgctatccagtttttttttttggatggtacagtctggggaacggaattctggggaatgttgcagaatcagtattttgactttacaatgcattttctgtgaataatattcctaatgtttattattttcatgtacctaatttcagtgtctctaaaaaggtggaacgtccgccactgcgccagtacttgatggatggcgacttcttcatcggggcaacgctcgcctctaccttgactaaattggtgctgcgattcatcgatctggaaccaaatgaaaagaagcagaatcgtctttgcacaagcgctatgctgattatgagctcgattcttcacctgggaaaatctggattgccaacgaaggccatcaccaacgacgatatggacaggattttcctctgcctgaaaactcttagccagcgtacgcctgaagttgtgcacatcttcaagcagtcttgccgagacgctttggctggtatgttgaacgctcagaatgccgaggagcaacagacgcagaaggataagcaaaaaacggccgccaaaatccagccggacgacccgattgcttttacacaattggccaacggaaagaacgaccagctgggagagaacgttttcgaatcgagtttgaaccaagcccttgccggcacgaagaacaccactctctccgatgtggcttcacccaacaacaagttgaacaaagtgacccaactgactggattctcggatccggtgtacgccgaagcctatgtccacgtcaatcagtatgatatcgttctggatgtgctgattgtgaaccagacgagtgataccctacaaaactgcaccctagagttggccacggttggagacttgaagctggtggaacggccgcatcccgttgtcttggcgccgcacgatttctgcaacatcaaggccaatgtcaaggtgtcgtcaacggagaacggaataatttttggaaacattggtaagtagtttacataaagctggatgtgtgacattttcgtcgggtttgagttgaatgtattgaaaatattacataggaaaagtgtaccagtaatggctatagtggtccccatttggccatatgtgttttctcgaaaactttcacattttgaatgttttaacatcaagattcagttgatatcaaactatactactgatacacttaaaatgagcttgagcttgattggccgctcgtggttgctgcaccagtatcgccagatcagctgcacttaacaaggaaccaaccagatgactgcttgggattaacagacaccctcagtgtataagtgctggtgatcttctatttttaggcaacaatggtgcctgctacgtcagaatgctgaccaatgaggggaaggggaaggagttgatgatgcattcactggctcccacgttagaccgtatataccactgcatctacgccagttcatgcgggaaaggttaaggggtgaggtattttttatggcagagaggcttgctgtttggttagcagactgccaatgtatcaggcgtaaggaaaggtgctataatgatggaagaatggaagcatagggaatcggttttttttgtccgtctcgggttctagcaaatgctatgaactgtgatacagtggcccaatttcataatcgtataggatactgttttcagatcaagttagtaaaaaactgttaaattatgtattgattttaaaatactttatccaaattgaaggtaataggtgtcatctattacttgtcaatcacaaaatgtttccatttacattcagctttggattaatggaaaagtattaaatttatgtctaaatttcacccaattccatattcgtacacctaccaaaattcacacatacaacattcaaagctaaatttaatagctctatttgattgcggaagtgcttaattatgatgctcagatatagtgaagtacatttagacaatttattagcggatatatattaaatttaggtataattatgaaaaatgccagttttccaaagatgtttgctataaaatccaataatatggttggaattccatttttgtcattggatccaatctattaatgatattcgtgagcactgatagaaatttacaatttacaatatttacaataatataccctaaactacgctgtacatacctccacatcattgatgttatcgcaatattcaattatttttgaattaatattcaaattagcaccctattttgaaatttattgattttataagaaaaatacaaaataatttgaatgagcagagagcattggtatatattgtactagaatatatcctgttgttttcatcattttaaaaaaggtttgtgttgcggttacggcaataatattcattttataaatctctataatcatgtttggtagtaaaatgtaaattaaaaaaaaataacgcaatgttttgatagaaacattaactatggattatgtatttccatttaggagtcatacataaagaaattgactaaaatttttggttttggatttgttataaatgttatagtacctaagattcaaaagtataatttgtcgatatctacttctagctaccgtcaaacggggtaacttgcaacactttccgatttcaattcaatatttctcaaagtatttcagctttcaatgaaaagtaaaaatgtgttgtgcactaattacggttagtttaaaactgtaggacactatttttttcatatatcgtactttgtttactcagaaaaatctaaaaatatgcgttctgcaagttaccccacataaggggtaacatgcaacaatacgataaaatgattttcgattgcagttctttattatttctattaaaaattgtttttaaacgattagaaaatgaataactatcataaatacggtatcaaatatatattaggggtcgtcctttatttacgtaaggccattttgagagttgttcaacctcaccttccttattgtttgaaaattaaaaataatttgtaaggcatctaaggaatctcaacctcccctcccccataatcctttaagtaattgatggacagcccctatcgtaacttattgtaagctcaatccttccacgcacaaggtagggtaaataactacttgagcacctccacgattcactttggcatggacggtttctctctattgaaactttgcaataagtagcacttcaatacgatgcaaattttggccagatataagctcagtaacttttggaaaaaccccttccgaagtgaatcaaaatgccaagaatatgacatgacgttcattttctttttttggaatcaacaaaggatcctccttgcttgcattgccagtagatggtttcttatcttcgttgctggactccttgttcgttgatgaaagaatatcctcaaccttaacggtctggccaggttcaacttggatccttttcttgcgtttttgggtgactgactcattttcaaatcgagcttcttttagaacatcgacgaaagcagctgaccacgactcgtctgcgttcttacctgcctcgctctcagtcgacggcagcttcttaaggacttgaaaacgattcaacggataaatacctgatgctctaaatcctgcccgcatattgtcgctggccttgtccattctatcgagttcttttttaaggagtcccgggaatacgaatttcggaaccgttcccttatgtttggtcttgtattcaaccaacacttccttccatttgatcttaagcggccgaaaatatgcaacattaagaggctggcaaaagtgtgtgctgttaggaggcaggaacacaaaccggatgttgtgatctcgacaagcttcgatcactgaaattgagaggtgactggccaaattatctccgatgagcaacttggggacagtttccccagcttttgagtcagcatccttgaaatgtttcagagcaattttaaaaaaccacacaagcgcacaagagagcaataaagcgattttaggctgtaaacatctgagaaattcttggcgattctgaagatgaaaccgagagttgtcgaagctttactgaccgtgtacgaaatatgttgtttgaatgataattgtgaatcaaggaaaacacctaagtccttgatgtgatccacacgttcgagactcgtcccgagcaaactataagggaacgctattgatcgctttttcctggaaaacgttatgatggagcactttgttggattcaccaccataccatttagagagcaccagctggcaaacaagtcaagttgttgttgcaggtacaaacaatcagcagttgagcgtattcgtaagaacaatttcagatcatccgcgtaagataaccgaggggcttagtagtgaatagtatatagtagttatagattcaaaagtataatttgtcctcctagctacttactttaaaactgattataattttttgaaacttgtgcaatattcgcagtaattattcttaaggaagtgatgttgaaaaaatgtaagttattgttcgacttaccgaatattttagcaaaaaaagggaaaaaggatatttttcttaaatttacttaagtttcaaatatgtccgcttataaattttccaaatgtacgctactacatctgaacaacacaacgaagaacttaagcaatcatccagtccattaaaatttagttttgaatgttgtttatttattttttgttaggtgtacgaatatggaattgggtcaattatagacataaactcaataagtagatgaaaaaaccgaatttaatactataccatttaattccactagagtttgtatcctttgacagatacgcgtatttcgacctcaaccatttaaccctctaatacccaaccccgcctttagacggggtacactttggaattttgtgtattttttcgtagctcggaaatcaaaatgattttatttatggcataaaccatgactcataacacgcatataagaaaagttttttatgacttttgaaacttttttgtattttttaaagttgtttgaaaaattgtattcttatataacctacaaatgcctgaggttcatttaacgtgtaatataaaaaatcgtacattttatatttttctacgatcaatctatctcaaaagaagagctttatggtattcaaataatttcaacactgttttttccgttaattacaaggagaataaaaaaaagtccagaaaaaaaaattttatcttttcaaaagtaccgtaaaaacttgaatttttattattacttaaaatcagtaactagaagaggcttcaagaaagaatgaaaaaggataaggatgttcaaaaataaaaatctcgcgttgagtatcatacaggcgtatctgcagtgatcgatttctcttcgtcgattttctctttggatcaatacaagaaatgcaatcaattttggtaacatttaacgatggaacatgacgaaggacgatgagttctttctacagaatactaaaaagcagttgaaagctgtctcccagccaagtaattagcataagagaaaatcgatgaagagaaatcgatcattgcagttacgcccttatgatactgaacgcgagaaattataaaaatcaaaaaccaaaattcatagatttgcgaataaaaataaatcattgcccaaaacgtgtttaaaacgattttagataactgaaaatgatatttagatcgaaaataaaaatttgggtaggtattagagggttaatagttttataccaacttgatatgaaaacagtgccccgtacgaaaatgaatttgagtaactgtagatcaactgtgataaggtaccgcggggcaagtgggtaaatggggtaagtgaaaacaattgatatatttgactcaatatgtgaattaacgttttgaactcttgcgtaaacctttgaggccattgagaacattacgataggtaagatatttctgagatttttcagccattattgcataatagagcgaaaaattgttaacctgtcaactgttactccgtaacaagttggcggcgtacaatcttattttaatattttcagtggaaaaaagttgcggaaaataatttcctgtaccacttcttagttgtcctctatgacagtttcaaactgcaataaaaaagatttggaattaattcgacgtagacctaaaagtaactaaatttaaacaccgtcaattttcttatcaggtggggcaagtgaaaagtttatcattagagattgaatttgtgttttctcttcaagtagccataagtaaacatggttcgcaattatcatagaaaaacataacgtgcagataattcaagaaacactatactcaagcgctgaaagctattagaaatcatggaacttctctaaaagatgttgccaaacattacaatattattatgtctacttcgggcagccaattaaaaggaagacgttgactgaaaggttgcaatattagagaatacacggaaatctcgtggaatgtctatgtaaagctagttcaaaacataaaaatggggtataggtctatccacataaaaaagattctaagtacgttattgaaggattccgtttgatttctcccgaagagttatccgacgtcatatccgattatctcaaaaacaaataacgagcggtggaaattctacagagcagaaatgcaattgctgccctataatgtaagaactaatattggaaatgttgcagttataatgttgttgaatcatttcaactaacataaatgaacagaagaaaattcaaatgaaacgaataacattttctttgtttacatgttatttatgttattgttcattgggaagccttaacaaatgttaaagctaatagaaatcgtgaaaataactgtttgtttttgaatttattgttcaaaacggtaaacttttcacttgccccacttttggggcaagtgaaaagtaaggagacatttttcaaaaaaattttctgtatttttttcttcaatttttcataaaaatcaatttcagcatgctgcttatatttggtgggagtcaagctaaaaaatatacacgacctcatttgtttcaatttaaagtctctggaatttgaagaatctcaactatgcgaattccattacccacttgccccacggtaccttaaattaagagtggtagatagaagcatgtgaaagatacaattacaaagtacgaggaaatgaacgggcctggaattgaacccatgatcttctgcgtatgaagcagaagcggtagccattggatcaccaaccccgtctgatacttctaaacttttcgcacgaaaaacgacgttattgttcaaccataccatttaataccatctcgactgtaatggtagcttcagaaatttacagaacctttgagcgatggaatgaacggcaaaattctattctgaaggcaatttccattgtaaattagttcattttgttgctccagtgataaacaccaaaaatgtatttcttccatagccaaatcatctacttgcaagtgaatttatctccgaaatcctatttaaaattatcccaacctgcacccaacctacgtcttgtatattatatttattcattcgaaatttgtaaattcaagattttttgcgatcatttctcccgactacccttgtgtttcggcgtaattctctcacgtctatctcgttccatctattttttaccactgttccggatcaaaaggtttaaataagcctctcgttatataacaactagaagcaagccattaattaaaaagaagcggacaaatactaagtggaacttcatacctgtttgtctgaagtaaggtaccgtggggtaagtgggtaatggatttagcatagttgggatccttcaaatcctagagactttaaattaaaacaaatgaggtcgtgtatattttttagcttgactcccaccaaatataagcattatgctgaaatttatttttatgaaaaattgaagaaaaaagtacagaaaaagttttcgaaaaacgtcttcttacttttcacttaccccacaagtggggcaagtgaaaagttcatcgttttgaacaataaattcaaaaactaacagttatattcaagatttctattactttaaacatttgttaaggtgtcgcaatgaacaataatataagtaacatgtaaacaaagaaaattttattccttttacttgaattttcttctgttcagttatgtttgttcaaatgattcgacaaaattataactggaacatttccaatgttatttcttacatcatgggacagcaattgcatttctgctctgtagaatttacaccgcttgttatttgttaagaaaatcggatatgatgttggataactcttcgggagaaatcgaacagaatccttcaataaagtatttagaaactttgttatgtggatacacctatatccatttttttatatttagaactagctttgcataggcattccacgagatttacgtgcgttctcttatattggaacttttcaatcaacgtcttcctttcaatcggctgtccacagtaaatatattaataccgtaatatttggcaacctttttttttagagaagttccatgatttggccatgataatagcttttaacgctttgagtatagtgtttcttgaattatcagcacgttctgttgttctatgatagttgtgaaccttgtatacttatagcacagataacagatgtttatgctggaacaaaaattgtctgaaaacctgtggaaatattcaaattgaaactccatgcaatcactagcgccgccacacagcgaattgcgtcaatcagtggtgaatatcagtatcatgaaatatttcatattcacctctgacatcgtcatgggaactcagcgatgacagcgcccccacgttgttactacttgtgttgccattcaaaatgaccattaatatgcttacacagttttacaatcggacatcaacgtctgttatctgtgcttatagctacctaaagagaaaacacaaattcgatctctaataagaaacttttcacttgccccacgtgattagaaaattgacggtgttttaatttagttatttttagttctatgtcgaatcaattctgaaactttttttattacagtttaaaactatcagaaaggacaacttagaagtggtacagaaagttgttttccgcaactgttttcctctgaaaatattaaaataagattgcacgccgccaacttgttacggagtgataattgacaggttaacaatctttcgctctattatgcaataatggctgaacaatctcagagttctcttacttatcgtaatgttctcaatggactcgaatgtttacgcatgagtttaagacgttaatttacaaattcagttaaatataccgattattttcacttaccccatttacccacttgccccgcggtaccttatttttaattttttttcatttttttgtcaaagtgtatattaaataataagtcaaatgataactaaaacatttgcaactttttcgttttgtcatacaaagtggtcaaatttaatggagttggcgatttcaaaggtaagaattattattttataagtttttgaatgtagatgacttaaatcatggaaaaattgataatcctgaatagaaatttcagcaattttctttaaaaatcgagtgttcggaatattaatcatgatcggaatttgagtacgaaacttagtttgactgtcaaactttgacaaaacgaaaaagttgcaaatgtttagttatcatttgacttattatttgacatatgaaagcaagcagctggagaatttatttaaatcttctatttatggaattgcaattacatagctaatgttttctaatatttgaaactataccatatcaatgaaatgctgttttgacgttatcaaactgcatagaatacatcttcgagcggtttagtggaatacctataaataaatgaaaaactaaagtcgggttttcatttactgcataaaatgatgttatacaatttatcgatgaagaaaagcttatgtatttgaagacattgcttcaaaatccatagtttgaaaactcaattttttgaaagccagataaaatatcaaaacttttgatgaatatgtccaacaacatccggctttaaacttttaggcatccggaaaaaatccgagaattggaaaactgattttaaatggacaccctgtatttaaattacctgctaataagaattatttagagaccgtacattacaagtccataaccattataatgcggccggtttgagccacggcgccggtagagagtgagggaggaggcgatctggctatggacgcacaatgtcgacaagccttgacaaagtcgacgatgtcagcatccaaactgggctaatagacgtagcttctggcgaaggccttcaaaaatgcgttgtacagttgtaatgtttaagaatttcaaagcttttgtagtgtttcttcttttcaaaaccactctgggattctatatatgtgacgataaagcctgattttattcatttttattttcagtttacgacaccaccggatcatcaaacgttgtagtgctcaacactatccacattgacattatggattatattctacccgccagctgtaccgacaccgagttccgctcgatgtgggttgagtttgagtgggagaacaaagtatcggtgaacaccacccttaccgatctacacgaatacctgaaaatgcttctcaaatcaaccaacatgaagtgtctgacaccggagaaggccctttcgggacagtgcggtttcatggctgccaatatgtatgctaggtatgatcgacggttggaacttcaggcagaattcttcttaaatatatctttttatttcagatcgatctttggagaagatgctctggccaatttgagcattgagaagccactggatcgtcccgacgcacctgtcactggacacattaggatacgtgccaagagtcaggtatgaatccaccttgcaatcgctatcactgcggaacacgtttttgtctcaagcaccaaaataccgcgatttactaaattaagggttgctgaatccattgccgttttcaaaaaaatcatagcacatctagtttttggaatatgcactgttgaaaatgctgaatttgcttatttcagccaacttgcgtgcaagtttgccagcttgtatggcaatttattcgcttaatttgccgcagaattcaaacttcatgtgtataacaattattatcaacaaagttcataatacttccgatgctcaaaaattattttttgatagtttcgaaaagtattttttttttgtcatataagaaaaaagtagaattttgtattaaccttcgggctgtcgcgctgttgtactttgtacaacagttgtgattaatatgctatcattttgcaataaagatatctatcgacaccaaaccaaaatgtattcctcaagaatattcttaagaacaatactcgacagtttttatttacagtatgaccctttataatacggtaaaatcaacaaatgtacatggaagtcgcataataatgaacgcactatatacggttcgaggaaaccacagtttgaaatcgtcatatctcgaaatccagataatatagaaacttggggtctttagtaaagttgttctggagggggagcgctatctgaaggtacctcatttaattcggaatttgaccgctaggtggccctagtgggcatgaaagttttacttttgttttgcagatttttcaggatcctgaccatttagaaggatgtcgtcttcggcaaagttgtttagtaagttaaggactatcatttttcgagctagttgatttaaaattttgccactaggcggcactagtgagcatgaaacttttgtttgcagatatctcaggagcctgaccactcagaaagatggtgtcttcggcaaagtagtttggtagctcaagggctatcataatttgagccaagaaatacaataatttgccatcaggcggcggtagtgagcatgaaatttttgttttgcggatgctgcaagatcttgactttttagacaggcacctttggcaaagttgttcagaagcttagggactacagtcagacctccatgagtcgatattgaagggaccatcgactcatagaaatatcgagtaatggaacagctattctttggaaagctgtttgaagggaccatcatagtaatcatgattttatgtttttagtatggttccatgagtcgatatcgagtaatggaacatcgactcatggagggatgactgtatcattatttaaataaaactctaactttaaggattaaacaaagaaagaatttgagctactgaacaactctgccgaagacaccatctttctaagtgatcaggctcctgagatatttgcgaaacaaatgttttatgctcactagcgccgcctagtggcaacattttgaatcaactagctcaaacaatgatagtccttgagttaccgaacaactttgtcgaagacgccgtttttctaagtggtcaggatcatgagatctgggaaacaaaagcttaatgctcactagcgccgccgagtggcaaaatcccgtatttcttggctataataatgatagcccataagctactgatcaattttgccgaagacgtcatctatctaagtggtcagactcctgagatattcgcaaaaccaagggtgttgtacaaagtacaacgcgcgactactcgtgttacaaaaattcgcgcgacgaccgaaaggttaagactgcaaacatgttcaaaaattcgattgaatctaaatttattcgtacaagttcaaccaaattttacctcaaatgaaagttgaagtcctattttacatgcttgatggcttagatcactcaaacgtttgacaaaccatactttaaatttcgtataaacatcaattaaaacagtgttttatacaactttggcaagctgtagctaaaaattgtgacgtgctggaacatttctgagaacggcatcagatacagcaaccctaaatctactagagacagatagtttgatccttgagacacacaaaaatgtcatttttgtttcgctgtgtatccattcataaatcagcattatatttttttctttcactcaccagggaatggctctcagcttgggcgacaaaatcaaccatacacaaaagtgtctacaggaaaaaccagttgcggcttaggatttgttttcctttaaactttaaattttatctcttgctcggaatgcgctgttataccggtattccaaatttgaacgattgcacttgcgagggacaaagagcggaacatagtgtgtagaatcccattcctatacaatatgcctagtattagaacaactttcggatgtcgtgcaaagagactattacgcaaaaagtaacttacagctataaatacacaccgttctatcacaaacatagcgatgcagatatacaaattgaacatcctggtaataagaaactcatgcatgaagttattgtttacgcaaactatttgactattaatatatattccacaatatgcgaaccagttcaatgtgtatcgaaagaaatgccatgaaatacagggctggtagcaggtgtctttttatagacttggtttttaaaaagtctacttttggtctgcaaagtttcttgttttatgcatcaagcttacttttttacctttttgatttccagtaaatcctgatgtacatttttgagaccgcagagattactgcgcgactattacataagttctacagaaatcctcggattgcaatggccgtgatcattatgcaaagaacaaacggacaatgctatatcttgtcagcaccgagcaacgatcaaaggacaatgattggaaagttggttcttggagcttgagaacccgcgcgtgttgggctcctggttcgtcaactgctggaagtcgcgtgaacgtgctagctattcaggaaataccctgacccaaaaccgtgtaaccagtggtgtgttgaagtgtccaagatttttgagattatcgtgattttgtgtatcgttttgttatcaaattacaaaccaagaaaatattaaaatattagaaactgtaaaccacccaagggccgtccataaatgacgtagcattttttcactgattttttacacccccctcccccttcgtagcatttcgtcacaaatgctggtactcccccctggaaaatacgtagcatatcatgcacccccccccccccctataatttttttatttctttttcttagtgactgggttgaaacaaaaaattggaattgagaagttcaatacaaagtttgatgttaattactgactgaaatgtaaggataatctaatctaacagtttgatatacagtagcgctcaaaagtaatttggaaatgttttaaataatttttttccttggttttggtttccagtttcatataggttttattatattacttttgctgttcttactatgaaaaacaagtttactataaaaaaagtgaaaaaaaaa

SEQ ID NO: 168 - DNA, 2912 bp, Aedes aegypti
attataatatcacatggaaattattaaccaaatcaattattatcatctgaattttacatgaaattcattgacagaatcccataattcgtatatatttatcacatcaaaggtatgtgttccatcagataaattcaatcaaaaccatctcgacactgtttatgtgatatattaatgaacgtcatgtgaaaaactacatggaaaaaaactataagtgttttcagataaatcggacatgattccttggttcagtgtgtttcctctccgtgctgatagaccaatccagttgcctgcgtagtagtgcaatgttgacaaaattttctttgtttgctgtgagaactgtcacaacattgcttttgtttgctgtgagaatccaaatataaacagaattgctgcaaaacaaccacttccttgttgacctgctgttgaccgaaagctcaataacgtcaaacaaacatcgatacgttttcattctgaggaaatcgacttgtgtaagattgattgtgcgttggtgttcgtggcagtttgcttggggacctctattgatccggaaattgtaaggttccttcaattgaaaaaaaatgcacgtctctagattttttcccaccgtgtcatccttcttggctgtcacttttgctgcagctcactcaaaatcggtttttgtttgtcatcatttcgctaaaaagtttcttgtagccgtcggtttttctacaatttcaagtaaaaatggcccttgctgatgtgtgtggtcttcccacgggaagcctaatgtccggtgccccgatggaccatcaattcttccagcgggatcttgcccttagcagtcaaaatctccacaacagtttctcccttgcggttccaccgttccaagaggtaagattggggaagaaggttatgttcctatggaagttttacaaccgagtcattgtctcgttccgaacagccggcggagaatctggccaaacttcaggcccatggcgaatccagtggaatcaagatggagttcgaccacggtaccacaacgctcggtttccggttccagggtggggtcatcctggccgtagattcccgtgccaccggaggccaattcatcggatcgcaaacaatgaagaagattgtggaaatcaacgactacctgctggggacgctggccggaggtgctgccgattgtgtgtactgggatcgggtactggctaaggagtgtcgcatttacgaactgaggaacaaggaacggatttcggtggccgccgccagcaagatcatgtccaacatcgtgtactactacaagggcatgggcctgagtatgggaatgatgctggccggatacgataagagggtaagtagcggattttcttttttgattggatgcagtggcgtacccacgggaggatgggtttcaggactcaggacagtaggtctccggctacaaagcaaagccatgttgaaggtgtctgggttcgattcccggtcggtccaggatcttttcgtaatggaaatttccttgacttccctggacatagagtatcatccaacctgctacacgatatacgaatgcgaaaatggcaactttgggaaagaaagcagttaaaaactgtggaagtgctcattgaacactaagctgagaagcaggctttgtcccagtgaggacgtaatgccaagaagaagaacagtaggtctcatagcatgctgcacaggctcgattatttttgtgcgctcatggcaagatatctcaagctcttgatatgaagcgcgtatcatgtataatgtatcatgtatgctgtcctcccggcagagaaccattcacttagtgattcttcacgatttcttctactgcacggggatacatatcttgaaactgctttcttcccaagtaaaactttcaagcactaaaactttcatctatcccacagggcccccaactttactacatcgattcggaaggcacgcgtaccccgggcaaggtgttctcggttggcagcggttccatctacgcgtacggcgttctggactccggctacaagtgggacttgacagacgaggaagcccaggatttgggccgccgagcgatctaccacgcaactcaccgcgatgcctattctggcggtattgtccgagtgtatcacatcaaaccgaccggatgggttaacatttccaaccaggactgtatggatctgcacttcaagtaccaggatgagaagcagcagaagtttgggtcttaattgcgttctcctagttcgatgattaactgataatattaatgcttggtattgtagctgtgaatgcagccggaaaatacatacatttggtaattactacacatttgtttccttttttgaagacctctatattttttagtcttagtccagagagttgttgacctgcctcatcagtcaggctaaggcgtgtgtggcctctgctgtacttaggagacgtctccattcgactcggtctatggctgaccgtcgccagccacgcattctgcgaagggtccgtagatcgtcctcaatcttgctcgcagcgcaccacgtcgtctagtgccggtcggattgttttcgagaaccattttcaccgggttgttatcaatactagtaacatgcccggcccaccgcaaccgcccattttttgcgaggtggacgatggttagttctcgcagcagctggtgcaattcatggttcattcgccttctccacgttaactttgtgcgatggcgagctttgcttgatcggagcgttctgcggagtccaaattaggcacgattttcagcaacgaatggactttttttcatttttcatatgggttttatgagaaatttatccacgattactttcagaaaatgctcaaaaaataccttcaggcaaaattttacaaacttttccacgagtttctcaaaaaaatcaacctggtatttagttcct

SEQ ID NO: 169 - DNA, 14230 bp, Aedes aegypti
tggtatttttcttaaatttacttaagtttcaaatatatccgtttataaattttccaaatgtattctactgcatctgaacaacacaacgaagagcttaagtagtcatctagtccattaaaaataagttttgaaggctgtatatttcttttttgttaggtgtacgaatatggaattgggttaattaaagacacaatctcaatacttttccattattccaaagatttaagcaaatgaatacagtttgtcattgccaaacaatagatgacacctataaccttcattattgataaagtatatcgaagtccatgcaccatttaatagttttataccaacttgatatgaaaacagtgccccgtacgaaaatgaaattgagccactgtatatagcttcgtggttacttgtgcaggatatacacatttgttttatacatggagacttaaatgcgacgttactcagaagtcaaagtcagtttatcttctctttacattcaagtgctttaaacggaattgattagagccgcattcctcgatgtttgtttgcggtttaaattccattcaaacatcaataaagcaggcaatagagcctactactactttgatgacttgtagctcgttttctgcccactgtgcagtgggtgctaccgcacgttcggtaaaactccagtcgcacccaccagttgtgtcagtttttcgctttgtttcttcaacggccggtttattcctcatcgcaaaaatcggaaagtggtaagcgcgtatccagacgcactaaatttgcatttttcctgtgcaattctccggataaggacaataatttggaagcaaatcgttttttggagttttaaccgtgcgtgcatttcgaattaatattgttaacgggtagtgcgagagaagtgttgaaggtaaatcattggtaaacagtgcccacgaggtggaatctgcccggaaaactatggaagtgaccgagaacaactttgagcgtcttgccagctatctgcagcagacattgagtcctgatccagaagtgcgacggcccggtaagaatctggtaaggttatggcgtgaggaatttgatatttacgtgtttctttggttccagcggaacgcttcatcgagagcattgaagtgagccagaattatccgctgctgtgcttgaatctaattgaccgactccaggtggacatcacaatccgagtggccgcggccatcgcgttcaaaaacttcgtcaaacggaactggggctaccatctggataacgatggaccggataaggtagccgaatcggaccggaacggtatcaagcagatgattgtccccttgatgctgaagtctccgtcgtcgatccagaaacagctcagcgatgcggtcagtattatagggaagtacgacttcccgttgaagtggccccagctgatggacgaaatgattgagaagtttgccaccggaaacttcagtgtgatcaacggcgtcctccagacggctcattcgctgttcaagcgctatcgctacgagttcaagtcgcaagagctgtgggaggagattaagtttgtcctggacaagttggccaaaccgttgacggatttgcttcaggccactttgggcctagcggaagcgcacgctaacaacgaagaagcgctcaaggtcatctacgggtcactggttttggtgtgcaaagtgttttactcgttgaattcccaagatttgccggagttctttgaggacaacatggacacctggatgaaggcattccacggtatgctgactatcgacattccatgcttgaaaacagcggaagatgaagatgcaggggtcttggaacacttgcggtcgcaaatctgcgagaatctctgtttgtacgcccagaagtacgacgaagaattcggaccttacatgccacagtttgtgactgccgtgtgggaactgctggtcaatacaggaattcagaccaagtacgacacgctggtctcgaatgcgttgaacttcctgagcacggtagccgacaggaaccattaccggcatctgttcgaagatccaaacgttttggcgagcatctgcgagaaggtcatcattcccaacatggacttccgcgtgtccgacgaagagctcttcgaagacaacccagaggagtacattcgaagagacatagaaggatccgacgtggaaacccgacgtcgggcagcatgcgacctcgtgaagaccctctcgcagaacttcgaatccaaaatcatcgaaatcttcggacaatatctgcaagttctgttggccaagtacgccgaaaacccagccaacaattggaaaaccaaggataccgccatctatctagtcacttcgatggcttccaagggtcaaacccagaagctgggagtcactcaaacctccgaactggttccgctccctcaattcacccagcagcagatcatcccggaactcgaacgcgccgatgtcaacgaacttccggtcctgaaagcagacgccctcaagttcatcatgaccttccgcacgattcttggaccgcagatcatcgtggccacgctgcccctggtggcgaaacatctcgccgccggaaacgtggtcgtgcacagctacgctgcctgcgccatcgacaaaatcctcaccatgaagggaccggacaacaagccgatcgtcaccaaggaaatcctggctcccctgagtgccgaacttataaccggtctattcgcggccttcaccgtccaaggctccaacgagaacgagtacatcatgaagtgtatcatgcgcacgttgaacaccctgcaggaggcgtcgctccctttcatgattgtcgtgctgccacggttgacggagatccttacggtcgtggccagaaatccctcgaagccgcacttcaaccactatctgttcgaaacgctgtcgctgtcggtcaagtgagtttctgaaattgtaatttcttatagcttctaaccaaattttcctgcagactcgtatgcaaagcggatcccaatgcagtcagctctttcgaggaagcactcttcccagtattccagggcattctgcagcaggacgttctcggtgagtattgaaacatgcacaagagtatacttccatatatggaaacgcaacaccgagtattgcgacatcccaaagaatcaactatataaagttagctaaaacaactagtattaataaccaagacctagtaaccagataatcgctcaggggagagtttcatttttttttttttcgagaggattcatagtactgcaaattggagtaacatagcgcagtactaaacgttaaatgctattaaccaggtcggacacagacccgcgaagagctttaggagtcttctgatatatggtccttctgctgctatatcaacttgatgtttgaagatttcaaagctgaacaacaactttaaattcttcaattttgggctactttatttcgcagattatatccatattattttagattgaaggatccaacttgcttcattttttgaatgttacattttccaaaaatagcttaattttatgtggtcttatataagaatgaattctcgccaataacacattgctatcattgcgcatcgtaccttcgtgctgtgcgtacacgaattctctctgctcttggaagttatcttaaaaactacctaaagcaataaaacagcacttttcagtgctttttagtgctaaaattataaaaggtactttcaagtgctactaaaacagtacttttcaatttttctactattgatccccttacgatccttgtttggacctgccttcgatttttcgttggacccattggcgaaagctagcggtggtaatccttcttggacaccgttttggaaaaaaaaaacctcttgggaggtctcgtcttctttcgtttattcactaaacatggtatcaacaacaaacaaaaggaaaagtgaatctctgaattcacaacttccttccaaaaaagtgggatttaaaactgtcattaaacgaggcaagaatggaagaaagaacgtttctccggaatgcaaactttcttcgaagggtgaaatgaataatgttgataattgtatcgaaatgagcaatcagttcgatgctctagacaaattttccgaacaccaaatcgaagcagcctctagcccaggctctttgattcatgtgaggaagcaaagagtgccgcctatcgtggtcagttgttccgaatttgggggatttaggcaggagatcttgaaatccttcaggggaatcaaggtttccttcaaaatcgcaaagaaaggagactgtcgcgttttgccggaaattcttaaagatcgcgaacttctcctcaaacatcttgaagagaagaagcacaaatttttcacgaaaaaactgaacgtttgttcaaagtcgtcttgagaggtctctcaagtgactataagtcacctgaagagatcaaaaatggaataaatgatttacttggattttccccagtccaagtaattattagttcactttaacaaaaaaaaaagatctaaataatattaaagttttagaaaaagctggacttatgttcgatgtccgtgtgacatgggaatattttcagaaacctggaggaaatttccagaacccaactcagtgacgtcggtgccaaaagtggggtcatggtacaaaacattgtcgcatggatgatttgcggaggttcttctcacgctaaggacgtctgtccagtgaagaaagatatcgataagtgcatatgcgcaaattgcgggggcaatcataggtctatttgttgggcttgcccttcgcgtagttgagtcgtcgaggctcgtgccaggcagatgaacggaaatgttcgttacgataacggtcgtttccggaatttttctggtagagtttcgaacaatgctcatttttcagttaacgatcgcttgattaaggatcatgtccatcagtaagatcataatcatgctcatttacaaattaattttaatccgtcgggtagccgttcgaatctattaatttcgaaagaaaatcctttgccgatatcgtagcaggtaatttgaactcctccccctttcatactacgagtagggcaagcgtatcattagtggtgcacctaagggaaaactgctaaaacatggtgataaaatcattaaatatatgattttaacatatcattcgatagacctcaaatccttctatcattcaaatgtataaaaacacgattcatttgaaattcccctgcaataagccttgcaccaataataggaacactgttcctttagtggaggtatgttttaagaatggttcctttagtggcgcaatccattgatttcttatggtactctccactatgggtacggatgcaccactataaggagcaaacattttaggcaaaataattgtgttaaatttcatgaatattcgattacttgtatcatttttgcataattttcgtgcgtaatagaaaagcatcacataatcattaagtagcgcaaaacatgccaaaacacactacctccactaagggagcgtttgccgtacccgttctaattgtttcaaatcaaatggaaaaaaaaccctgccgccacaggaaacttctactccgcctcttcgttaccgaaaattctaacgaaaaatcatcagataatgtacccacttcaagtgatatatttgcctctaattttaatgttctaactgaacaattgaatctaatgattgatgcaatgttcaaagccaccactatgaatgaagcagtccaagttggtgtaaaattattaaattaaattgttattggattacgtttttcgaatggatccaaataataatttaaatattttaaattggaatgctcgttctctgaatggcaaagaggacgtgctgtttaattttctaacagctaataacgtgcatatagcagttattaccgaaacttatttaaaacctggatctaaactaaaaaaagatcctaacttttttgtttatcgtaatgatcgacttgatggggcatgtgggggagttgcaatcatcatccataggcgtataaaacatcaactgttttcgtcatttgaaactaaagtttttgaaactttaggtgtttcagttgaaacactacttggtaaatatactttcatagctgcctacccagtaaacattttggctggtttattttttgctatacatcattctatatgaatcatatcactcgtataaaatgcatgaaaacgctatatacacaccaaagtggaggccatatacgcacttcccacgactttttcagactttccatggtcagcaatacgatgccacaaaattccaataaaaataaaaaaaaagttcccagtgtgactcgaacaccagacctttggatccctaacccagtaccataccactacaccactgaccgcttcatgaataaggagtgattatttgccaatatgaaaggaagtttgctctacaacacacacgctttgttgttctttgaagcccaccgccagaagataccaacctcgggtgttaaatttcggtaaagttattgcgatttcatttgatgctagtctgcattgatatatgatctgtcagtttatacatcttgacgcgattctagattatactatttacggcatggtttgttgtcaacaaagtttgtcgacaatgaatcatagtggagaattatatacaatttgtgttaacatttattcgttatgatttggcatattgtgcgattctgatttttgacgtatgaatatgagatttttggcacacattcttatacgatacgtggttcactgggtatttgccttttcaatgctctggacagcaagttaatttgctccaaactggcttgcgaaaattgactcgcaataagtcaattttttttgtcattggtgactttaatgccaaatatcggtcatggaataatcctcaaagtaataccaacggcagaattttatttgatgagtgctattcaggatatatctcaattcgataccctgatagccctacatgtttttcctcttctagaaatccatctacgattgacttggtcttaaccgattctagtcatctttgtagtcaactgattactcatgctgatttttattctgatcatgtccctgttacatttcaaatatcccatgaagcgattctcaatcctatcagcttcactttcaattattttcgagccgactggaatatatatgaaacatatattgactctaatcttgatgttaaaatttaacattaacagccaggagcattgcaattccaaaatgtgaataaaatttgaatccgtgattatagacgattatcttaaactcttgatccgtcttaaaaacgtgaagagaaggcaatttcaacgcactcgcgatcctgctatgaaaattatatgccggatttgcagaaagaaatcaagaaacgttttgcacaattaagaaacaaaaattttgaaaataagatttctcaattggaccctggctctaagcccttttggaaattatctaaaatcttgaaaaaaacctcagaagtcaataccgacattgaaagaggaaaacaaattattactaactagggtaggtgtaccaattatggacatagtggttccctatttcgccttaaatgtctcaacatttcgatttttttgtgtcttagcagtacgatatagggtttatcttgatgttaaaacattgaaaacataaaaatgtgaaagttatccgaattttgcatatagccaaatagggaaccactatggccataactggtacactttccctaattgcgaaaaagctcaaaaacttactatgcagtttgaaagcgtgcacaattttaatttagaacttactagtccaattgaaaatcaaattactcaggacttcgaaaatattctcaatcaagagaacgttttcgaaaattcctggaagactgatttggaagaaatgagaactattattaaaaaaatcaaaaatatgaaagctcctggcgatgatggaattttctacatcctcatcaagaaacttccagaaagtagcttatcatttttatttgatatattcaacaaatgttttcaattagcatattttcctgacaaatggaaaaatgctaaggttgttccaattttaaaaccagacaaaaatcctgcagaagcttctagctatcgtccaatcagtttgcttccctccatcagtaaaccttttgaaaagaatctttttgaacagaatgatggtccacatcaacgaaaattcaatttttgccaatgaacagttcggattccgccatgggcattcgaccactcatcaacttttacgtgtaacaaatttgatccgttccaacaaatcttaaggctattctactggtcttgctcttctagacatagaaaaaatgtttgtaaaatcttacttaaggtaccgtggggcaagtgggtaatggatttcgcatagttgggattcttcaaatcctagcgactttgaattaaaacaaatgaggttgtgtatattttttagcttgactcccaccaaatataatcagtatgctgaaatttatttttatgtaaaatgaaagaaaaaagtacagaaaaagtttttgaaaaacgtctccttactatccttatatctattgaacaataaattcaaaaaaaataacagttatattcacgatttctattatatttaacatttgttaaggcgtcccgatgaacaataacataaataatttgtaaacaaagaaaattttaatattgttacttgaattttctactgttcagttatgtttgttgaaatgattcgacaacattataactgcaacatttccaatgttattttcttacatcatagaacagcaattgcatttctgctctgtagaatttacaccgctcgttatttgttaagaaaatcgaatatgacgtcggatagctgttcgggagaaatcaaacggaatccttcaataaagtatttagaaacttttttatgtggatacacctaataccccattttttatgtttttagttagcttttcatatacattccacgagatttccatgcgttctcttatattggaacttttcaatcaacgtctgccttttaatcaactgttcgaagtgaacatattaatatcgtaatatttggcaaccttcttttcagagaagttcaatgagttaaccatattaatagcttttaacgctttgagtaaagtgtttcttgaaatgtcagcacgttctgttgttctattataattgcgaaccttctatacttatagctacctgaagagaaaacacaaattcagtctctaatgagaaacttttcacttgccccacgtgattagaaaattgacggtgtttcaatttggttattttcaggtctatcacgaattaattctaaaacttttttattacagtttgaaactctcagaggggacaacttagaagtggtacagaaaattattttccgcaacttttttgtactgaaaatattaaaagaagattgcacgccgccaacttgttacggagttatagttgacaggttaacaatctttcgctgtattatgcaaaaatggctgaaaattctcaggaatttcttacttattgtaatgttctgaatggcctcaaaggtttacgcacgagtttaaaacgttaattcccatattcagtaaaatatagcaattattttcacttaccccatttacccactttccccgctgcaccttactttactattgctggctctacgtccttcaagacatgacctgcgccacaatgttacgccaactaactcggtccatggctgctaacctccaattcctcgatcgccccacacttccaagatcctgctccacttggtcaaaccaccgcggtcggttcctccagccagcagatatttcgtcttcgacgtatttaccttcaatccaacccgatctgcttcacgtttcagcttggtatactgttcagaaaccacctggaacgttcttccgacaatgtccacgtcgtcagcgaaacaaatgaactggctggatttattgaagatcgtgccccgcatgttgtagcccgcccgtttcataacatcttctagcgcaatattgaacaggaggcaggaaagactatcgccttgtcgaagtcctttgcgtgtttcaaacgggtccgataatgcacccgatatcttcacacagcactgtacactatccatcgttgctttgatcagtcaggtcagtatcccgggaaaaccattctcgtccataatcttccatagctcttcgcggtcgatggtatcataggccgctttgaaatcgatgaataggtggtgcttagggacttgatattcgcgacacttttggaggatctgcctcaacataaagatttggtctgtcgtcgatcgcccgtctacaaaaccggcttgataacttctcacaaatctgcttgccagtggcgatagacggcggaagatgatctgggaaagcactttataggctgcattaagaatggtgatcgctcgatagttctcacattctaacttgtcaccctttttgtatattgggtatattattccctccttccactcctccggtagctgttctgtatcccagatcctggctgtcgatcggtgcagccaagtaggcaacctgtccaagcccattttaataagttgcgctccaataccatcctttccagctgctttgttgttcttgagctgtttgatagcatccttaacttcacctattgtgggagttggcacatctcccacatcagccgtactgatgaagccattcctcctgctgtcttgatcttcctcctctgcgccgtttaggtgttcatcgtagcgctgcttccacctttcaatcacctcacgttcgtccgtcaagatacctccatccttatcccggcacatttcggcacgcggcacaaagcctttgcgggatgcatttagtttcttgtagaactttcgtgttccttgagaacgatacagctgctccatctcttcgttccacgttttgacgggtgccttgctgcagtataatcgcccgcgctgcattcttctcgtccaaaaccgtctgacactcctcgttgtttgttttttctcttataagcaggtgaaatcaactcacctataaaacatctgaactgcaatggcaaattaaatgtaatatgttgttaacaaaatgttaataaaatcctcaatttgtttaccaaattaggatgatagtgctgcctaacaacacagaacacctagatataagaaatgaatgtaatgtttgaaatgatactaaaaaaaactgttgcatttgaacgcgttcagtttacgttccagttcaaatttttgaacgagagaactagtattgaacattgatcagttcaaaaatttgaactcaactcaaaagagctgattcatttttcagcgaaaggaaaattcgttttcagaacagatataaaacaaagagataaaacaaatttaaaagcagaaagatttctaaagatgtcaagggacatttaaggttccatacattgtgcgtgaaatgaattcaaagtagtttaagcttcactgtgcatttcaaagtgaagtgaaagtgaaagtgagcagcgttagaatcttgcacgaagttcaatgtttactgcgctcacgtgcaaaattagaacgcgttcagttcacttttggctcgcgttcaaaccaagaaccaaccaggagttcaattttttttcgaagcttgtgcgaactacctatcagaggaatttcaaatgatgtcttactccgctaaacaagtttgctgaatataccatctatttcaatcacgtgatgaatcagtaaaattatgatggcatttacacacttactaaaaaccatttcattaatgcctattcaggtatacaccaacagaaaatccttctgatttgtcatctttctaaattacagagttcatgccatacgtgttccaaatgctgtcactgttcctggaaatccgcgagggtaaaagtgccatcccggatacgtatctgtcgctgtttccctgcctgttggcacctgctctctgggagcgaccgggcaacgttacgccgctgattcgactgctgtgcgccttcgtacgtcaagcttccccacaaattagcgccgatggcaagctgaacggtgtcctcggagttttccagaagatgatcgcctccaagagcaacgatcacgagggattctacctaatgcagaaccttctgctgcactatccaacgtgagttttttaggtaaaactcaaggagttcatgaaataataaaatttgttttaatcatttccagtgatgaactaggacaaagtatgtgccagatattttcgttactgttccagcgattgagttcatctaaaacaacgaaattcgtgcggagcttcatcgtgtttctatgtctctatgcatcccgtgtaggagctcaggctcttgtgcagcttatcgacaacatccaaactaagtaagtttgccatctcatccatcattactttcaagtattacttaatatccagggattgaatcctgagaaaattgagagaatcgctcacgtatcgctctctgtaactatcataacatgctgcacattatgagagactgcttatcgtatggacctatgcacgagttcactgtttgacgtttgagcggtgccgtgttatttacgtgaccatagcaacgagtgaattcggcaccgctcaaacgtcaaattcgtgaactcgtgcatcggtccatactgctacaagtctgatcagattggggggatagtagtgcatgataaaacccctctaaacatgctctaagcctgggggacactgttgttattggaagttcgtggattgtttatcgtgccagtaaagaaaaacacctatcctcaacggtaaacaagcgagaaaaatggattttatcatcgctctctcgttggggctctcgctcgctgcttccatttatcagacttgttacaccttgcgatacaatgacgatcgtggaccgcaacagatgggatgtttttctttgcttgctttgatcgtgcttcattctcaaatgagagcgaattctgcaacgcctgttaatatctgattcttccagcatgttcggcatggtcatcgagcgtatcttcataccggacatcaacaaagtgtccggagagctggagcagaagattgtctcggtcggcatcactaagctgctctgcgaagccccggagcttctgtcggatgcgtacgtaaaattctggccccagctgctgcaaacggtcattcagatctttgaacttccgccggacgagtccaacattgacggtgataccttcattgagatcgaggatgtccctgggtaccaggctgcctattcgcagctcaatttcgctcaggccaaaccgatcgatcccttgccggaggtggccaacactcgtcagttcctggtgcagaaccttggcaaactggcccaatcgaatccgggtaagatcggagtcctggtggcgtcgctgccagtggcccaccaggaagctctgcagaagtactgcgcccagagcggggtgcaactcgcttaagttacatttatcattcgcgcgcttgatattcgtcacatactaccatgtacactcattttcatcgttctacaattaaagccaactacattaagccatagggtatcattagtgttatcgtgtaagtcagagtttgaataaagctactaggtgttactttttactcgggttaccatccttttgaaagatgtgctcctgtctgtatcaagttattttaatgacacccaggatattcaattgccataagcattaacggacgaacgcgtcaggtgattggaaggtggaagtagcacttcaatgaacacatgaatagcactgagagaacccttactctcaaccaaccaactaagccagttaaatgtgatcattgaaaaaagagaacgcaatggaatcaaggaaacaaaaataatccaaacaggatttaaggaataaagaatatgatatacactacccaccaatagtatgtaatcgcatcatcgagtgtgcaacacccgatttaaatattgcaacttcccaggagccttcgttctgagctcgattcccggccggtccaggatcttttcgtaatgaaaatttccttgacttccctgggcatagagtatcatcgtacctgccacacaatatacggatgcgaaaatggcaactttggcaagtaaagctctctgtcattaactgtggaagtgctcattgaacactaagctgagaagcaggctctgtacgaatgacgacgtaatgccaagaagaaagaacttcccaaaacggc

SEQ ID NO: 170 - DNA, 4471 bp, Aedes aegypti
acgaaaaacgagttgaaaaggtaacttctttatattgtcgcaccgccaccaaaccggatcgcgccagtgagactcgcgacgcgcctcaactcgcgcgattttgaaatcagttttttagtgtggcgctgcattcttacgatttttatgaacacagcgcactattcacatattagctgcgacgcacggggcccgagaaaacaataattatatataaatgttggtcttgatttctaccggatacataatatgtatacaagagtccgatatccaaaaattagttcggtggtctgtatgaatgatatttttgacaggatgcgtgaacagaacgtgttgacagccatgttgtaatttcgtaaaatagtttaaataacaaaagagagaaccaagcaatcattaaatcacttaaatgattttacttacccgcagtttgctgttgataatcttgggtacgaaccagagggcgagagttggttcctaccaaaacgacgccacatgacggtgcgaggagctcactcgccaccactcagcagtgctctgttcattgatgaacggagaagagagtttatcgatcacgtcatttgactttcatcggcggtgcgaagcgcttcgagtctctgcccagttccctcgaaaagtgtcggatatcgtagaaaattgattggtaatccgttcggtggaatcgtaaaaagtgagtaaaagtgttcttttcttataccaaagtgaagcttccccatttcgagtagttaatgtgaagaaatcgcacttcgatcgattggcttgggcgttgaccaagatctcatgactgtgtggtttatgtggaattagaagtggtacaagtgaatgtttatgctaaagttgtgcgccaaaagtgctaagatattgaaatttcctggaaaaagtgccgaatttatatttaagactattttttctgctaccatatgcacagaagttgcgtcgccattttgtttttgatcaatcaattttccggcgcttcgcaagctacctggtgagatctttcaaagttcattgagtggtgcagtgacaagtgagttgagtgccgtgagttgaaagtgtcaaagtgctcgaatttgttgtgttggtgaacactgtttatgagctgacaaggggtctaaagatttgtagttaagtaatctttttccgatagtacagtgacttacactcatattcgtacatagcattgttttcatatcaagttgatataaagctacttcggcaacaatgaaggtcatataaactgtattcatttactttcatctttgtaaaaatggaaaaatattaaaattttgtctaaaattgacaagttgcgtatgtacagctcagtattttaatatcaatatatcactatttgattgttttttactaactcgatgtgaaaacagtgtcgtgtgcgaatgtataattgagtcacagtgtatattttgtcttcaaaattaaactgttaggtatacaaatgcaaattaacataatattggtgaaaggggtgagttttctcaggcatattttgttataaatatatttacaggtaatcggtacttgcgcagaccaagctaaagctggccaaatttgatgaggacagccgatgagtagcaaccggtcaagcgatagagatcgtattactgtgaagatacgtaacatgaaacgtagcgcctcgcgcgactccccagcaagatcaaagaggcgcggaagcattggccgttacgaaggaagctcggacgaacgcgttaccccagacaggatgagacgacgcgtagcaagatcccccagtccacgaggcggaagtacccgttatgcttctccccatcgcgaagagtattctcgtggagggcgcgaaagtggaagtgaacggtactcgtacaaggtattgtgcgttagtgctctgcatcccaaggcatctgacgaatatattaaagaatcattgtatcgggagtacaagaaatttggagattttagcattcgcatttcgcatgatttggacgaacgggtagcatatgtttgcttccgcacgtcggaagatgctcgagaggcgaaacatgccaagtcacgaatttctttgtacgacaaagcggcacttgttgagccagtttatgaatcggccaaatcagaatcgtatcgtagaccacgttcttcctcgccgcaggattatgaccgacactattatgcccgttctcctggagttccaccgccggatcgtcgccgcccagagcatcacccatacgatggatacggaccgccacctggtcgtatgcaccatccggacttccgcccaccaatgcatcatgaatacatgcctcgtggaccaccaatgcatcatcatggaccaccgcacatgcatccaggtcctcctcatcatcactatatgccacgtccgtatcttccacgtccaagggctcccttcgacaagaacgacaccaagaaggacaaattccccaactatctacatcacgttcaaccggaagatgatcccttggccactaggactttgtttgccggtaacttggaaatcaatatctccgacgatgaattgcgtcgtattttcggcaaatacgggatcgttgaggacattgacatcaaacgtccgccaccgggaactggtaatgcttttgccttcgtacgttatcaaactttggatatggctcatcgcgccaaggttgaattgtccggtcagtacataggcaagttccaatgcaagataggatacggtaaagctacgcccacaaccagaatctgggtcggaggccttggtgcatggacttctgtcactcagttggaacgtgaatttgatcgttttggcgccatcaagaagatcgaatacaacaaaggggacactcaggcatttatcctatatgattcaatcgatgccgctacggctgctgtgaaggaaatgcgaggcttcccattgggcgctccggatcgtcgtattcgtatcgatttcgctgataacggaacaacgccacccttcccgaagcgtggaggaggtttcgatgaaggtggtgaatatcgtcgcggtcctgactatgaatatccggaaagttcctatgaggaaaattcatcgtacggctacgggggaagacctttccgaggaggtcgaggaggattccgtggacgtggaggtttccggggaggattccatcgtgatggtccaccacaccatggagatggagacgaatggcgacgatcgggagctgatggcgactacgattcacgtcgtcgctcaggatcccgtgaacccggaatcgacagatctcgttctcgttcgccgcggcgacgcagtccagctgattccgattcggattcgtccactcgtaggaatggtatgctatcgaatgccagaactttaccagaagttgcacgtaaatctacaaccgtctggcaaggtgcattgattctgaagagctcgttattccctgcaaagttgcacctgacggacggtgacaacgatatagtggacagtttgatgaaggacgaagaaggaaaacatcaccttcgcattacccagcgactgcgtctcgaccaaccgaagcttgaggatgtgcagaaacgtatatctacgtcatcgtcgcatgctattttccttggtctaccgggatcaacatcatccgtcgcatcttccgacgacgccagcgtgcagacacgtcccctccgtaatctcgtgtcgtatttgaagcagaaggaagcagccggcgtcatttccttgctgaataaggaaacggaggcaaccggtgtgctgtattcattcccgccgtgcgacttttcaacggaattgttgaaacgcacatgtcacaatctgaccgaggaagggctgaaggaagatcatctggttatcgtggtggtccgaggaggaaccgcctgagtgaatgaagagggcaccgttagtaagtaaggtaagatgagattcaaactatcttccgattatttagcgttgcatgcgtagttttgcttggcggtttacacctaacacatattccagggaatgtctcttcaccctcgattaagccgtaaaccacgtttacttactcggttacactagttttgaaagcttatcagttagatatcaatgctagtgtagctcctttttttgaacgcggttggcagcatcatagctattgatttgtgaacagaacatctaatcccaggcccatcccttccatcttaccttgtagttgcatatctaataagatcttgcttctttctcgtaatctacttcgtatagggagtatctcatttggcagaatgattgtttggcgtgatggtcatatgacatgtacattttaaatttaaataacgaatttatttttgattattttatgtataaatattaaacttaacactgaacaggttgtaattagtctttgaagaaatcagctaaaattaaacaaaccaaatacgccatcttcaaaacatggctaattttcacatctgcgaatcacatcattatcagataatatagtta

SEQ ID NO: 171 - DNA, 16309 bp, Aedes aegypti
aattttgacaggaggcggtgtcgtaacgtgtgaaagtaacagcaatatcatcagtgttgccgtttcgtaaaattgactatttgtaattttgtaatttgaactttattatagttcaaattcgttatttataacgtttattatataaacgataacctgttagttgaaccacagacaaacagacgtaacacttagaacaaatttcgatcaaaatcatagtcacgagaacatgtacgcccaatgctaaaattagtgtgtttggccgacaggccaacagatggcggtggtgtgtaaacgtcaaacgcgaacagaaacgatgcgagcgctgcgggtggtcgattggccacctactgtatttttgattcgaccgttaaaaaggtggtcgatggccaatgatgagagtgtgacgtctgtttgtctgtggttgaactttacatcgggtcattcactattcgagcaatttagaaataactttatatttcgagcacggtgtgcaaagtggagcctctactgtaaggctctcgaacttaagcacactttaccttggccagtctaccacgtaactcatttaatttcattgcatgtcaaataaatcaaacaaaattttgaaacgctctcgttcggtcaattcgcgcaatttgtacggaaaatatttgatgaaattgagtttttgtatgtttaatatttaattttatatcaaagtgatgcacagttgtactttactttaacaagtatgttaaatttgtttctcaaaccttcaatagataaacaatttctttgctttcggcagttgcaggttatgttattgccgcttactccaaacacagtttcgaatccctgagtccgaatccacgatgagccaactcgaacgctcgctgcttctgctggacgaatccgtcgtcaaatccaagcgagggcttctccgggcaaaagaccgtgagctacgcagtccccatcaatcgctgctgggtgctggtgagccaaatgaatcgacaaacgccgaatttgatgtgtccctgacggtgggaccgcacgaactccgtagcttcatgtacgatagccagcagaataatctgtcggctagtaggttgagtttggccggaagtcagatcagtacgacgggactgaatgtgaaacatcggaccgaggcattgttcgggcagtttttggaagtgctgcaaaggaggaacagcgaagcggaggtttttgaaaccgttgaggatttgatagagaccttggacgaggttttgaatggcatcgacaaaatgatgtcgcagactgcgtttgggaagcaaaggaaagtcttggccgatgaagcgtggttgaacgtagagcgagatacctggaagctgctgtttgccctttacaaagatcgactggtagtgcagaaggaagatgccgaaatggacgatttgcctttggttaacagcgagagggcaattgtggagcacttgtacgcagcgaatgccaatttaagagaataccagctaattgtggattggttagaacaaacggcattggaacagaatcgaatgcaaatcgggcattttacggatcggacaattgcctgggagaatacactgcatcagttgcaaaacgtcggattgaccgcttttggaagtactagggagatagtgaagagtttggatccggatgcgccggttcgagagcgtcgtcctttgcacgatttggacgttgaggatcaggcgcgtctttctagacaaatcttccaggaggtgcgattcgggagaattgaagaagcacaaaatctgtgcgagcactgtggacaaccctggaaggctgcgatactggaaggatggagattgcatcacgatccgaactatgaacctgcagcagctacttccggcaaggctttgaccgtgggtgtaaagcaggccatcgaaggtaatccacggcgggatttgtggaaaaagtttgcctggaagatggccgaaagtcgagccgtggatgattatacccgagccaccattggatcgttctgtggaaatttagattctctgttgggaattctgggtgatcatgattggactgacgtgctgtgggcttatctaaaggtaagtttttgatccaatccaacgaacagagttgataatcaaatgctattattccatcccaaatgcccagattttcgggcctctgtatctgagcttctggtagtccgaattggaagaaatctgaatgacgaactacaaataacctgaagtttacatcaaagtgccaagaaacttactgaccaatactagggctagacgttcaaacgctgattaagccctaactctttctaatactgtaaaaatttaccgtactccgttaatttattttaccgaaccgttcagttgttgagattttacagtaatccgtaaaatagtttaagtgtgaaggcttaattttgagaattatcgacaatgaatcgcaaattgtaagtttgataaatagcagctagaaatgctgacccgaatttgtcagctccccttttcacggagaactttttgttgtcaccgttccattgtcgagttttttcccaaccttttacaatcctgtttaaattactatggatactcataacacaggaaagaaatatcattgcttgaattttctagaggagccgaaacaggttttgaaaaagggactgacataatcgagtcatctatgtaacccatttacttcggctagcaatgatcccctgactatacacgattattctgagacccagaactaattacgcatgcttcattagtatggtgcccggaaactttggaaaaatgttttattgaaattggaaaaattacaaggactggctaccacattcatagtacgtctgtaccattgatagaggcaatagtaacgggctgaggaataaaaaatcgccaaaacataacggaaggtcattttttatatctgaatacgtcatttgaaagctattctattctatttcacgtaaaaaataatcttagaatgatagaataattgaatctattaaaaaatcattttctccattactggaacatgttccagtaatagtggtatttgctaacttgtgttcctataatagtagtgatttcccattgagactcactattataggcccgccccactattactggtgcaaaggggcaaaaaggttaagatttttaattgttttctactatttccttactgatatccaagatttttttatacacattcatattattttagcaagggccatgttagaaaaatacaaaaaaaatgcctattagggtcaggcggggcaagatgagcaccctaaggataagcgcgatttaagcctacttaaacgttattattttggtaaaattggtaaccatccttatcttttacattattactttgacctccaaccattaaaagttttaaaaagtgataaatagttttccaaataacacgttaaaaatagcttttttatcatcggtcaaaaaaactgcgggcaagatgggcacccccataaaaagatgcaatttaccaaagaaaactgttagttttcaatgtttgcaatatcccgagatattttcataatatctgataatatttatcttcaactagcttagtttttaaaacttttatcagaaaataaataacttttcataaattgctaagattttacttaaaaaaacgattaaatttgttgtttgtatattttttagaaaaattgttttgtgcaaagaagataccgtaagtcaagcccacagctaaatgtggttctataatttcacacttttacttaattttgaacatggtgctcatcttgccccaagggtgtaaatttattaatataatcaaaacaattgaaatatttttttaaatttgataaaaagttttggtcctgattatctacagaagattgttctataactatacggtcaaaaacgaatgaattaatttgtttacgcaacaaaaatatcactcttaaattaacaaatcttatatgaaaaggtaaatttttggacttctatgtattgttcattttgttgaggaatagattctcatgcacattttgaacgtggcaaaataaatactcacacgtcagtttctatggcactttaatagaagcacgcaacttgcattcaatgtacaatccaacatgttgcgttacatgtgcgttacttgttggttttgttagctacgacgccatccaatatatggcaaacatagtgggagaatattttggtgggacaatattttttaggtgtgagtctattggagggcaaaatcctcaatatttttgacaatatttacgttgtgctgttgattttttagctgaaatttgtggccatcatatcactttaattatattcatcagaaccccaaataatgtattgaaaaaaaacggtaggaacgacacaaactaggggtgcccatcttgccccgggtgctcatcttgccccacattcccctacacgcttaaaatcgcacttctactattgagcaattctcgctgaaaccaggccgccatcggcacccatcgttagaattccaattttatgtcactgatcgctagttctcgataaaacttaagggtggtcctttctgttttctcaaattggtggacccctcgtacgccagctagctgaacagtttgcgaaaaagcccatttttcgataaatcttgggtgtttcttcacgggatatgtctcatatttcgcttggaacacatagcaaacttagtggcatcgtatagagaaaggatatagctttcatttgaactcgaaaaagttttggcggccattttgaatttggccgccatcttgaattttgttagaaaaatcgttttttcaccattagcgcaccgctagttttgaattctgagatcaccatcagaaagctgaggaaaaattgcgtaagataggctacagaaactaggtgagcaatggtatttaccctatcaaatgaacgatattctaaatcatgttatacgattttgacgtatatggcgagtgcaatcaatacaaaaatctttttttgtactacaaagaaacaagttttcaacctttgatgttttattcgagtcgagtgaagaataagaatattattttgagtgaaaaaatctggcggccatcttggatttgacgccattttcattttaggtagaagaatgaatttttcaccttgatagcactcagcatgttgaaattagaggttaataataaaaaaaggttacgtatactcttcttcattttattcttaattttccttacgttacgtccctactggaaccgagccagatactcagctttattggtcataaatccaggttattaaataggaatttcttttataatgcgatttctgacaacagaataattcttcaacatatctttgaattcagtagtaatgaataaataaattcaataaataaaaaccgtccaaaaacattgattgtattaaacaaactttttttaccatatgcattgttgttcattgaatgaaatttatagattgcgcgtcgggacattagtaagtcttgtggtaatatctgtagttttaacgtaaaacattgacaaaagtgcattaattcagaatggaaatcttaaattttgaagcaaaaacaacatccttgattttctgagccataaagtatcgttttaagtaccgcccaacatgcatgtgaaatatagcgagattgaaagatgagaagcaagttttgttctaatgtggacgtaatgccgaaacgcaggtgtattatttcgaggttgttaaatctggcggccatcttggatttcgacgccatcttggtttttagcagttgaatgatttcttaccatctcagtgctcattatgttaaattatgaggcctccgttaaaaaaacaatcagattctatttttcttatcttatctcagctgttcaactgattgttcatttctatcaatggttttagacaaaataaatgaaagaaataatgctattttcaactcgaaaatatgcagaagaatcattcaggtagcaaataagcgttaaaaaatcatatttgataatttgttttcaaagctagttaagctgaggggctggctctgttccagtagggacgtaacatcaggaaaaagaagaacaagaagaagaataagtgtaacggtagcattaaaattcaacatattgagtgctatcaaggtgaaaactcattctactatttaaaaacaagatggcgtcaaaatccaagatggccgccagattttttcactcaaaatagtactcctatttttcagctgtctcaaataattcaccaacgattgaaaacttgtttctttgtagtacaaaaatgatgtttgcattgattgcactcgccatatacgtcaaaatagtagaacatgatttataaaatcgttcatatcatagggtaaataccattgctcacctagtttttgtagcctatcttacgcaatttttcctcagctttctgatggtgatctcagaattcaaaactagcggtgcgctaatggtgaaaaaacgatttttctaacaaaattcaagatggcggccaaattcaaaatggccgccaaaattttttcgagtttaaatgaaagctatatcctttctctatacgatgccaccaagtttgctatgtgttccaagcgaaatatgagacagatcccgtgaagaaatacccaagatttatcgaaaaatgggctttttcgcaaactgttcagttagctggtgtacgaggggtccaccaatttgagaaaacagaaagaaccacccttaagttttatcgaaaactagcgatcagtgacataaaattggaattctaacgatgggtgccgatggcggcctggtttcagcgagaattgctcattactgggacacacactactactagatcagccaccctaacggtgcagcgttacaatcaataatgactggatggaaacaacatgcaattttgatcgtacgtacaatgtagtagagctgaactgctctgtctaggatatgggaggaccgcaaatttgcccagcatcaatgcaatggtagagtatcattgtacctgccacactacacaatactatagtttaaccctctaatacctagccccgcctttagacggggtacactttggaattttgtgtattttttcgtagctcggaaatcaaaatgattttaattttggcttaaaccttgaagttttttatgatttttgaaacttttttgtatttttgaaagttgtttgaaaaattgtattcttatataacctacaaatgcccgaggttcatttaacgtataatataaaaaatcgtaccttttatatttttctacaatcaacctatcacagaagaagagcttgtttaagttatttaacaccaaataatttcaaacctgtttttccatttggtaattacacggaaaataaaaaaaataaaaatgaaaaaattaatatttttaaaagtattgtaaaaaataaatttttattattgccaaaaatcagtaactagaagagatttcacgaaaaatgaaaaaagatagggatgttcaaaaataaaaattataaaaatcaaaaacaaaaattcacaaaatttgcgaataaaaataaatcattgcctaaaacgtgttcagaacgatttaagataatgatagagatcacaaaaataatgatcgaactcaaaaatttgggtattagagggttaaggaatagaaggaaataaaaaagctgatgaactgtcagaagttggatcatccacactcaaaaaaatccaaacgtcatagctacgtgaaaaaacacgtagatccctaaaaattcattttgcttgaatttacctgattaaggtaacatgcaccgaaccacagataaacatgaaatgaagcttcgataattttcactgcggttcacctatccatcttacgtgaaaataacgtacttgccttgattcattctgatcgtgttcactgtctaattcattctgtgttgtgatgaagtgttaaaatggcgtcagtaggaaaacaaacttcatacgttgagcaatatttggatgcgaatttcgtttctgtccttaggacgtttataaagatagttttttttgtaaagcagcaccagtagaccagttctcaaaattgcatcgcttttgtaaatattatcagatgagcgcacggcttaggacttggtgctggatgacccatcttctctcttgctgaaagccaagcgtaagggaattttctatattgcatattattcaatgttcttgttgtatctatgtttcttgcggcattcttctattcgtacaggaacgatggctgcaaataccggctaaggaatatgtttccaattgcatcgatgccaaaccccacacccattcaacaacttcgatgtacagttgattcgaaatagcaacaagttcgctgataaaactgttgtgcctctttgaatctaataaaacattatatattttcacccggaatgacaatgcatattctaaatacaatgcaaagcagattaaattgatatctttttttaataccacaggaatcatattttaggtaccatcaaatcccttggtgaataatacggcaaaaacacgtaggtcttacgtggtgctccggtgcaataaagaaagttcatttgttcatcggttcattcttcttcacctatgattcccgtaagagctacgtgaaaagtgcgatggaaaaaaaacacgtatgttttctcgtaacaatgacgtttggattattttgagtgcaaatatttactagggcccccagagccgttctgtagagtctctccatgctccattaaaatggaactcaagagctgggaagaagttatggcaaataccaattgaattatgaagtccatcaatctaaaaagttgataaaacccaacaaatcaaataaggttccgcggggaaagtgggtaaatggggtaagtgaaaataatttgtatattttactgaatgtgtgaattaaggtttcaaactcatgcgtaaacttttgggtccattcagaacattatgaaatgtaagaggtttcctgaggtttttttttattgcataatggagcgaaaaattgttaacggtggggattgctcatcaaaccttccggtccgcctcatagttacgtactatttggtgctgggtgtagttcttgtttttccagctgtattgaaaagcatgagccatagtctttggcatacaatcggatctatctttagcagaaaagaaccgaaatgtctatcgacgaccggtgattgctagcagatatagtggagagcttgtcttgaaacgttcatcgcttcaagctagttgaaaaactgaatacactgattgcctgtcgatcagagccgaactaggcatagatcgtatacatacatctgaatctacatgtctccgatgtattatatcgttccaggtgggagttatctgatatgtgaatatggtaccataacagaattttccatctgaacgaagtgataaatcataatattccgcaaactgtatcacacatctacagaatgtattgcgtgaagttaagacacagcagagtattgggtacataggaccaagtccctgccgggtggcgcgaaactgatgagcgatagacaatagaatcaacaacactgccataagggatagtaagcatgtgactattgtcgaaactatgattaggaggcaaatcaacatcccaagatcaaatttttgttacaacccaatgtaggtattattaaattaggctgtagaaaatgataaatatctgatcacttaggaaccttgcaacaggtaataaatgctcgtagtctgttttcttcgaatacacatgtataaattgttaaaattgccgaatcatacgcggaatttattaaccctctaatacccaaccccgcctttagacggggtacactttggaattttgtgtattttttcgtagctcggaaatcaaaatgattttatttttggcttaaatcttgactcataacacgcatatgagaaaagtgttttatgacttttgaaacttttttgtatttttgaaaattgtttgaaaaattgtattcttatataacctacaaatgcctggggtttatttaacgtgtaatgtaaaaaatcgtaccttttatatttttcttttattaacctataacagaagaagggcttggtggtattaaaataattccaaacatgtgtttccgttatttacacggaaaataaaaatattttcagaaaaatatttgaaatttattatttttaaaagtaccgtgaaaacttgaatttttattgttgccaaaaatcagtaactagaagaggcttcaagaaaaaatgaaaaaggatagggatgttcaaaaataattataaattataaaaatcaaaaaccaaaattcatagattggcgaataaaaataaatcattgcccaaaacgtgtttagaacgattttagataactagaaatgatatttagatcgaaaataaaaatttgggtattagagggttgaacggatcatgaaatcaggactgaaatcataatgatgatagattatcaactttcctttcgtcttgctatttgttaccgttagaatcaccaaactgattggtttcccactacttacaccaatacaacagcacgataactgaagtattataatcgcgcgttggaactttcaatatccatatattacatcaatagtgaattcttgtatgtagccagtataaataacagaatcatcaacttcttgaacattctttaactgaaaacaggatgcttgttttatcaaacatgctcaatctgcacctaaaatctcggatccaaatagttttctaaataaaaattgtgtctaaataaaacgtgtaggccaacaaaacataattgagtaggagtttacaagttacttagcacatgaaaagcagtgtaaattaatctattactagatcaacactaatgctcacatttttatattcccatttcatcatggtcctcattgctcgagcggagacgaataccctggagatggaaaaaatcgacagcgctacgataaggaaacgtaacagatgagaaactatcgatacatttatcaattataaaaccccgttttaatgttaacactttgtttctgttttttctgtttttttcgtttcagcaatcaaataaccgaaccaactctactatcttttcatttcttcttcgttatgcttatagtccctctggcactgaaccgagtggagcgccttccgctttcttactggtgctgtctttcctgtacatttggcatagtgtcggatgtggtgtactgtatttgctatacaacgcgctactttcgatattgtgcttggcgtgtggggaagcagtactagtggtgaagcggagggcgccattcggtttagtgccagagggactatatctatttaatgtatctgaagcttgtgggaccgctttaattccggcgcctgcttgtggaagatcccggtgtgctaaacggtataggacatgttaacgggggaggcttggtaggtcctcacccagcccgtgtctagatgggcggataattgtctgccagggtgtggattgagcaattacaattacaataatggagcgaaaaattgttaacctgtcaactacagtcgactatccacaactcgatattctatgactcgatggatttttcggtcccttcaaagttccatacaacgtgcactccataagtcgatatttctattactcgatatctccactagtcgatatcaagtgaaagggaaatttctctccataacttgatatctattttaaagtcattcttatttggtaaaccttggtctacagcggggattcgctgattggatcacgactgctttccatctagcgaatacaacccgttaattggaaggactgacagctggtgaaatagtggttatcacgctcaatggtatgggtgccctagtgtagatgtagttgtaaaccttagaggaaaacaatatgcactctatctcgaaaaacacccagaatccgggtatatattttgcaaattgggtaatatttccatatgcattttgatgactctggaaagcgtgtgcaagtttctttgaggaaaacaaaaacaaactgtatatgacgagcgtatgctagtctacgtgtgttcaaatgtcactaagctctattactccagactaacgcatctggagcgcatatcgtcacacacatctacatacacttttgttctatatgtgtagacttcaatagagcttagatctggtgatcaaaagaagggaaaatcgtcgatgaaaatgttagtagtcataatgccaacgtaggaaagaaggcaaaattgtcaatgaaaatgttagtagttacaatgcaaaccactagtttaacaacgtaatgagaaaaaacagcctatgaccaaaagaaaggaaaatcacatgtgagaatgttagcaacggtaacgcaaaaacatagcaactcagttttcaatgattctgccaaatgtccatcttgctaaatgactattatgccaaacgaccgttatgataaattattttatgccaaacggatttatgccaaatagcgtccctccatcttatttcaatatcttaagtggaaaaaaatcgcggaaatatttttttgcactatctctaagttgtcctctctgacagtttcacactgaaataaaaaaaaagttttagaattgattcgacgtccaccttgaaataactaaattaaaacaccgtcaattttctaatcacttggggtaagtcaaaagtttctcattagagattgaatttgtgtttgctcttttgagtaaacaaggttcgcaattatcatagaaaagaagaacgtactaatacttcaagaaacactttactcaaagcgttaaaagctcttagaaatcatggaactcctcttaacataacaatattaatgtgtctacatcggacagccgattgaaaggaagatgtcgattaaaaagttccaatataagagaacgcacggaaatcccgtggaatgtctatgtaaagcaagttcaacacacaaaaatgagttatagcgtataggtctatccacacaaaaaaggttccatatactttattgaaggattccgttttaagaaatgatttctcccaaagagttatacgatgtcatatccgattttcttaaaaactaataacgatcgatggaaattctacagagcagaaatgtaattgctgtcccataatgtaagaactaacattgaaaatattttatttataatgttatcgaatcatttgaacaaacataactcaatcaaacatttattggaacatgtgtgggcactggtgcactgatggtatattgctctaaatcctttcgatttaaaaatagctcataatgaaaaatttagcatttattagcaaactggggtatttgcgataactttaaagtgggtgatcaaaacgctgtgaaattttcactgcacaaatttgaagttatttcctagttgcggtaaaaatcaaacttggtcattttgtatgaaaaacggcaaaaaaatctttttttcgccggtcgattgggggacgggacttgagtagtggttagaactcacaactctcacatcgaggacctaggatcgaatcccacccccgagatagtcacttatgacgtataagttatagtgtattccgactttccatttccattaccttaaggtatcttgatcaagggttcgtaaagccctctgatatatagtgcttagctccattaaaagtagttcggtgtatgcaacatattattccccattttgacaataccgaaatcataagttgaggataactatacatagtaatttatcaccttgatacacggtaatacactgggtggtgtatctcagtaaacagatcgaacaattggccgcagtaataatacattacacccctggaaaatttcccttaaaaatgacaaaacatcaggttatttgtagttggtcaatcaaatttcagcaaattcggacaaccagaatctgagatacagattcccaaacttgggcattttgcatatattttgtcactgactgtattacttactttcatcaattacagactcaaatcgacatccgcgtcgagagcgaaatccgatcgcactgcgtcaaaagttatcttccaatgccggagaagtactggaacagcaagatgtctttggagcagatcttcgaggaattggaggcgcacaaaaacattcgcatcaaaacggccgcccgcgatgtagatcgtgtcattcagaagtatctgattctggatgatattccggagctgatgcgccagttcgatgcctggctttcggatagttccttcccgttgacggcgcagatgcttcgtttcctaacccatttggtgttattcattcgtcagattggaaagcagtgccaggaagacattggcgataaggttattaagcgctacgtcgaatgtttgatcaaacacggcgatgcccagctggtagctttctacacagccgctctgcccaccgatttgcaactattgatgtattcgagcttcctggaaacggttaccgaaacgcaggcaaggaaacgtgtcttggaagaagcgtacaactttggtttggacgttccggccattacggtctacacggtggagaagattcggaaccgcgaagacgagtcggacgtcaaaccacaggaaggtaagttgatttgctaaggtgaatattaatcgaagccaaacctcaatttttcaagagaacaaatctggggaaccaaacttaaatttgaactgaaaaaaattacgaaaaagaaaactatagttgttcaaaagctctggggtcaatatgaataatacagacaaatggttaataacatgttgaaccattttccttctcaggtgacatcacacctctggatcagacaaaaatttcctcgctcgagtggctcatcttctatccggatcagcgaggtgaactgctgtggcaggcgaatagtttggttcgcgccttcctcgccaaacgtaacgttgaagcagcacggaaagcttttgctgtggtacctgttgatacgattcagcagataatcaacaactacggctcgaaagatgaccttccacgtaaggaggaagccagcatcaaagaatatctttgccatcaaacctacctggcggcgattgacggttacaacgattgggttgagtattactacaacatgaagccgaaagccccacagttggtcaagtccaacaactttacggaacgtgttgcctcggagcatcgcgagcaaacctaccggatggatctggaacgctggcactctcagctgcaggaacagaccacggttacgcgggatctgttgtacaatattctactatttcccgagaagggatggctcatcgatccggatttcgatggcaaggaagatggccaagaagaggaagactggcttaatcgggccgttcaaatggaaaacttgcgaaaattgtgcattcccgatgtggtactgttgttgcaccagatattcacactttccggacgatacagcgagagtttacaactagccgatgtcattagttcggaacaacgacagctttacagcgtctactcgaagtacaaactggcggaggttatgaccaaaattgccgagtcttcgttagcactgatgaatgagaaattggatccattcgttggagatgaaggaaagaaaaagtaagtttggatcgtgttagtatggtaagtagacttttttcccagtataagttgtttgcatttaaaataaatatacttccaatgtaaattatttgcattcaatttttgagaaaattcatgagaggaaagtgttgcactgggtagcaaactccgataacaatagagaaggatatggcagagctttgagcattgtcgatactctgaacagaagaaacgattgcgaagctatcctgcgacaaatgcaacaacgttcaacctcatttactgcggaataattcgaatatgaagctaccttttcagcgcacggattgagcaatgctctttatggcctgcgacgtgttttcaattgagtggcgtcgatctttgatttccatctgacacgaaatatgcttcgtcgaatacttgaccgtgtaaaatttgaaaatagcgacagaaaagttttctagttaaaggcttgggaagggggtccctagccttgaggttacgctttcgctacataagtggaaggtcatgggttcgattcccagcccctccacaaaaaaaaggccagccatcagaagacgccgcacggaggaccgtgctttggggagcacatccatcctctgtcagtatcagatgatgactgagacaaactgaccctcttcgcaggcagctagcctcaaacgactcaggaacacggcaaaacgaacc

SEQ ID NO: 172 - DNA, 4572 bp, Aedes aegypti
ctatgaacaaatcgcgatcaaaatcatagtcgcgaaaacatgtacgcccaatgctaaaaacactgtagttggccgatagaccaacaggtggcggtagtgtgtaaacgtcaaacacgaacaaaaacgacccgagcgctgcgggtggtcgattgaccacctaccagatattcgaatcaatcgttaaaaagttgtgcgatggacagcgatgagagtgtgacgtctgtttgtctgtggtttaacacaaggtagctaaaataacattgaaatttatatttttcgtatgcatggtaaagtataaaataataagctttgacatgcttactatccaaaaaagtgacaaatgtaataattctcgcataacttctgatctcgccctaaaagccattggtaaccatatgtgtagctcgttgtttctgagcatttgcatggaatttcatgttatttaacaacgttatggggaaggatcaatatctacctgctagtgatgttgctttggatgcttattctaccatttgctcagaaacatccagctacgcacgtggttaccaatggcttttagggcgttatctcagagtatgcgagaattgttattctaattagcatttccaaagttctccgtgcactctgatttattccgagtgttcaacttttttttttgctttggcacaaatattttccgtgcatcattgtccctctgacagccgaagctgtcggcaggagagggttctttgtttttgtcactgtcacactaatccaaaacacgcattaacgcaacgtaaacattgcgaggagtgctggtgtttttattatcgtacagaaaacgttttgttagaaagtttgaattaatatttgtagagatacctactaaaatacagggtataaaagaaccgttagggttgctgtacaatggcgcacattccggctacatcactgggaagtaaaagcaagaagcactttctcggtgttccggctcctcttggctacgtcgccggtgtaggaagagggtaagttaccttactgaatttgggataccaagaaagttcctgtttaaataatacattttatccttatctctagcgcaaccggtttcaccacccgttctgatattggtccagctcgagatgccaacgatgtttcgtaagtatcctgtaatcgtttacccttacctatgtaaaactcataagagttcattttccagggatgaccgtcacgcacccccagcagcaaaaagaaagaaaaaggaggaagaggaggaggatgacgaggacctgaacgattccaactatgacgagttcagtggctacagtggttccttgttttccaaagacccctacgacaaagatgacgccgaggcagatgccatctacgaaagtatcgataaacgtatggacgaaaaaaggaaggaatatcgcgagaaacgcttgaaagaagatttagaacgatatcgccaagagcgtccaaagattcaacagcagttttcagatttaaagcgtaatttgattgcagttagcgaggacgaatgggctaatttgccggaagttggagacagtcgtaacaagaagcaaaggaatcctagggcggagaaattcactcccttgccggacagtgttctgtcgagaaatttaggtggagagtcgaccagcacgatcgacgggagatctggtttggcatcaatgattcctggtgtttcaacgccgggaatgctgacccctagtggggacttggatttacggaaaataggacaggcaaggaacaccttgatgaacgtaaaactatcacaagtatctgattctgtcgcaggacagacggttgtcgatccgaaaggatatttgaccgatcttcagagtatgattccaacatatggtggagatattaacgacataaagaaggcaagattgttattgaaaagcgttcgagagaccaacccaaatcatcctccagcttggattgctagtgctcgtttggaagaagttacagggaaggttcaaatggcacgtaatttgattatgcgaggctgcgaagtgaatcctctgagtgaagacctttggttagaggcagcacgtctacagcctccggatacggctaaaggagttattgctcaagctgctcgacacattcctacatcagtaagaatttggataaaagcagccgatttggaaaccgaggtcaaagccagaagacgtgtattccgcaaggctttggaacatattccgaactctgtcagattgtggaaagcagccgtcgaattggagaatcctgaagacgcaaaaatcttgctttcgagagcggtggaatgttgcaacacaagtgtcgaattgtggttagctttggctcgattggaaacgtatgagaatgcacgtaaagtgttgaataaagctcgtgaaaatattccaaccgataggcaaatttggacaactgctgctaaactagaggaagccaacggaaacattcacatggtggagaagatcgttgatcgtgccctgagttcgctcagtgccaatggagtggaaatcaatagggatcagtggctgcaggaagctatggaatcggagaagtcaggagccataaaatgctgtcaggcgattgtgaaagcagttatctctgttggtgtagaagaagaggatcgtaagcaaacctggatcgatgatgctgatcactgcgctaaggaaggtgcatttgaatgtgcccgtgctgtgtacaattacgcgctatctgaattcccttcgaagaagagcatttggttacgtgcagcttatttcgaaaagaatcatggatcacgtgaaagcctggaagcacttttacagaaagctgttgcccattgtccgaagtcagaggttctctggttaatgggagccaaatccaaatggcttgcgggagatgtaccagcagctcgtggtattttatcgcttgcttttcaagccaatccgaattcggaggacatttggcttgctgctgtgaagttggaatcggaaaattccgaattcgagcgtgcgcgtcgattgttggccaaggcaagagcaagtgctccaactccaagggtcatgatgaagtcagccaaattggaatgggctctgaacaatttggaagatgccctcagcctcctggaggacgccgttaaagtattcccagattttgcaaaactttggatgatgaaaggtcaaattgaagaacagaaaaatttactcgaacgagcagtcgacacatacaattcgggtctgaaaaagtgtcccaattctattcccctttggctgttgttatcatctctcgaggaaaaacggaaacttctcaccaaagcccgttctgttttggaacgtggtcgattgaaaaacgccaaaaaccccattctatggctggcagctattcgaatcgaaattcgcggaggcttcaaagatatggctaataccctcatggcacgtgctttacaagactgtccgaatgctggtgagctgtgggctgaagccattttccttgaaccacggccacagcgaaaaaccaaatcagttgatgcgctcaagaagtgtgaacacgatccgcacgttttgctggctgtttccaagctgttttggagtgaacgcaaaattcaaaagtgtcgcgattggttcaacagaacggtaagctaaaattaatgtttgattctgactcccattgcttcatggatttgtttttgtttcacagatcaaaatcgatcccgatttcggcgatgcttgggcgtacttttacaaattcgagctgcaacatggaacggaacagcaacagaaggacctgttggagcgatgtgttgctgcagagccaaagcatggcgaagagtggtgtcgggtaagcaaggatatcgccaactggtgcttcaaaacggacgaagtactgaaagcggtggtcaagattctacctactccgatttagatatgctaaggatatggtaaggttttgattgtgtgttgtattccatttcaataaactgaaaaattgaaacttaatgctagtgtacaaagggttattaatctgaaatctctttttacttgcaaaattaatgaaacccctcatttattttatttgattctttattcatatttgtcgatgcacatttttcaattttcccctcttcttcacggtacgtctattccccttggattattctgaaaattccttcaggctttatccacaaattacgtaacgctctagggggctactcctcggctcaagcgttacggctcatacacaaagcattacggaagggggaaggggcttaaacatttccaattttcgcgttacgtaataaatggatgctgcctcatcaagttttcaaagtttgatttcaaaaattgcattgagaactgtaggggaaagtggggcagtgtggccaccttaaagagaagtcgataaaagtgtcgaaaatattatgaattcttcgaatgtttgcatgatttccaacattttgtagatgaatacacatccgcatgatttcttttcttttttgatagatccgcatgatttcttttctcttataaagttcacggataaatgaatgattttacaaaatttgtaatttttcgattcgattttttactgatgggg

SEQ ID NO: 173 - DNA, 2614 bp, Aedes aegypti
gaatgcttcgaatccaggacaccgtccttaaatcacacaaaaaatatgttttcgacatggagaatgtagaagacattttaattatggattttaggcgaacaaattggaatttggtccaaaaacacagtgaaaaaggctagtgtccggctttcaaaacgttcggctatttgatacagtacgatatttaagggagctattattaatataatatgtcaagtgcaggttcaaaaagaaaatcgacaaatttcataacgccaaaaatgaccattttcgacacccacccacccctaacactttttgtataaatatgtttacgaattttgtatgagctgtaacaattcgatgacacccacccaccccctttagcgttatgaaatttgtaaagtattaaatggaaaatcaaattttgaccaaacgatttgatgaattggttcacagcctttacctcacacgaatcgaactgttcacatctcattttgttgcgatattgaaaacccactgggggcatgcaatgctgtcagcgtcccgcgcggtgctgtcactcgagctgctataattttatgctcgcagaaaatctcttctgtttccggtctccactcagtcgttctcttttcacttgtagtcgtcgtcgagtgcggtcgcacaacgcagcatcatggcgtaagtatttctaatatttttttctcttacaatgtgcttctattataactgatcttaaagtggatggcttttagcgaaaattatcgttttgtattacgttattcacaaattaagcaatataaaagtgatcaatttaaaataatatgctcaacattcaatgcaattttcgcaggtcgattttcaaggttatgttctaatgagagccgctttttctcttctacttccagaaccaaagtgtcgaaggatatcctgtacgaatgtgtgaacgaagtgctgaaaggctcgaagaaaaaacaccgccgcttcctggagactgttgaactccagatcggactgaagaactacgatccccagaaggacaagcgtttctcgggcactgtcaagtacgtttcaacctgatcttccggtgggtgaccccacattggttgagaaatcaggaagtctccctccatggggagacggacctgcactcagggtcttaaaacaaatgaggaggcttggtttcgacggcattctaccctgtgtgggtgtcgctcggacctcgccgaacccccttttgcttctcctcgattaacacttgttcaagagctctcatccgtcagcggtggtgagttggaataatcccattgacccgtctcctgatagatttgtgtttccaagtgagtatgagattattaatcctggatttgtttttcctccatacaggctaaagtacatcccgcgcccgaagatgcaggtgtgcgtcctcggagaccagcagcactgcgatgaggccaaggccaacgacattccctacatggatgccgaagcgctgaagaagctgaacaagaacaagaagttggtcaagaaactagccaagaagtacgacgctttcctggcttcggaatcgcttatcaagcagatcccacgtctgttgggtcccggtttgaacaaggccggtaagttcccgggtctgctcgcccacagcgaatcgatggtgcagaagatcgacgaagtcaaggccaccatcaagttccagatgaagaaggtcttgtgcctgtcggttgccgtcggacacgtcaagatgaccccggatgagctcgcccagaacgtgcatttgtcgatcaacttcctggtttcgctgctcaagaagcactggcaaaacgtccgctcgcttcacatcaagtcctcgatgggagccgcccagcgtctgtactaagattggatggaaacggagcggtccggatcgcggtaccattttacggtactcgccgggatcgcctatgatgtacgtatgttacaaacttcggatagacttatgcataagtaaaatttttgcaatttaaatacaaccggatcgttgcaagaagaaatatgccggcttgcctcatgaaagaaagccataaagtttcttcgttcgcttagttgagaggtgctcatcctgtgagtaggatgagaagacgattcaaagaatcttctgtcaaattcgtttttgaacttaagctggcactgtacgcaacccgttggtttgtttgtgtttatcaccgacctaaaaacgaacacgacattaaattcagggctggtagcggctgttcacctatacgacgtatagataatgaaaaacgataatttgaattagtttcccaaattgcaacagcaagccagtaatttcattactcggaagacaaatatggggagccagatcctatgtaatctggtcgcaccggctccttaggggtaatcagatttatgggggagggagtggtgtttcttacgcgccatacaatttatttttaattgtcatgcaaaaaatcttaccaatggggggtatttgaaaaccccgaagattgtattacgtaattaaggatcgctccttgtgtgatcttttcctttctttcttgtttctcaatttcgtccacactgatggcaacacagttagttccagtttcaacatcattcgagccaggcagtaatg

SEQ ID NO: 174 - DNA, 78178 bp, Aedes aegypti
tgaaaaatcttctgtggattttttgccttgcttctccgaggaacaggacaggatcacggcggtaaaggtccaccagccattccctcattcagccactgagtatctcaatcacctgctttcgctgttttttctttagattccgttttaatcgtaggcctgttgacggcgctctgctatcggactttacttcccttttctgctagccaaaacaagttcattttcatcataacgaagctaccaaacgcaagtgtcaaaaaactgcggaagtaagttcggaagtcggaagtctggacttccgaacttcaatttagtgctggcgacacaatatagcgtttactaccgagaatgtagtaaactcaactttactacattttattcatacggcccaatgaatgagagagttggctcagtgtggtttttttctccgtgttgggtgagtgtaccgtactcattatgcaaacggtcgtttcaaatttgtcgaatcacccctttcctcaccgcgggcgcgacatgagtgagcggaaacagccaccattttggttggctaccctgctctgagagtggagtccgttcttcgtttgcaagcaaattatcattctcttttccggcagtcacgaagtaggaagcattcttgtcgttcgcgtcgaaaaactgtgaattagcgaagaaaatcgtgcaaatttccaccgaaaaccgttcctgcgcgagtgcaatcggatcgcgagtgtggaatgaacgtattaaatcccaagccagcgtcaaattcgctagatagctgaggtaaatgcggatttttctccgggtcaggtcggggcgagtcccttggccaggctgcttgtgttgggatttttcaagatggcggccgctgcctgtcacggtgggcttcggtttcgggaaagcagtgaaaaattgtttgtatggaaaagtttcatgttatttcaatttaaaaatgatttagttataaaagtggataaaagtgatgctcttgtttgttatatttaaacgagaattgctttgttgccatgaaataatagaatcaaacaagataaatgaaatatgaacggcaatcgaatcatgatcctaattcaagaccattaatagaaaatgcctcaaatcaaaaagtaaacaatgagaaaaacgttagtggcttatttttttagcatctttagtcgaggcgtcctaaaaatcattcaaaattgatggtgaaatgaggaaattgaagtgtagaaaaatgttaggaggtcaaataagatacttacatggggatttttacggtaagaaagatttaacgggttggatctttcgtcatcaatgaacataatgtaggcagggttagtatcaggtatcttttctaaaacttgacctctgttttaatggaatttaacaatttaatgatttcttgagcatcttttttaaccaaaattacatatctccaaaatcactttttttgcatctccttgcagaaattctggttgtaaatacctaaccagtaatttccaacgccgattttctagttatttcgccagccattttcatatgttttccttcgtgaatccatcttcttctagggattgtttcagggaatatattttaggaactcttccagggttccaatggtccatcaagttcattactcctgcagtatttcctaaatatctcgagtattttttcaagcaaaatctccaaatattcttcaaaatttcatcaccatactctgtccatttctacacccgttatttgcggaattctgtacaatgttttgaaaagaatgtttctagaaaatcatgcaggattttttctagggattcaactgattatttttttgcaataactatcatagaaatttggatttttccagaattttttattgttttgaaaaatgtccttcacaaatatttctgtcctggaaacgttactggacaaattgtttgaaaacttcctctggaaatttctcatagaatttctgttggacttttgaaggaatcgtaagaggaatctctggagtagtttctaaaggtgtatgcttagtggaaacttggaaaaactagtgacaattctggaggaaaaccttagaaatctttggagtaataattgcccgagctcttgaaaatgacctgaacgtaaatcttgaacgaaatcctagtgatatcgattgttgaatcattgaatgacgaaaacaaaatcatcgcaattaagcccaagtaaagaatcaatgtcgatttgcgacatttatcctggttagcgaaaaaggagatgggaccttatagaaaaatgttatttattcaactttcatacatatttttgaatggttatcatatattttagtaagaacatgctcttatatacgaaaatcagcagaaacccgatttgtttacgttttcgatttaagtgatcgccaaatcagcagccgccaaatctgttttttttctaatgatgatacattactacatattacaaatgaatactttgcttctctattcttgagtcgcagagtatcttcagattacaatcgaggcatttgtctgatcatttttacttgtcaatgacagtagattttgttaatcaaaagtataggaactaatcatagcatcgtttgatgtttcccttttcagatgattaaaaaatgaatgaaggtgattcagcgggagggcaaagaggtcgaaacctagcccttcctgctgggacagaccgcataatatcaagcatcaatagttcaggccatgtaagtgtagaaccttattaacaccattggaaatggatgataatcctctcttttgttttccagttgcccgtagggcctgtggttgccgcatcaccaatgtcccgttcgcctgccgacgaaagacagcataactttcagcagctccaacagcaaatgcagagtacttctcctgcgacaggacatttgaacaagccacttcatcagcaattcaccgcaaataatacggttagtttgatcccggccggcacagtcggtgctggtggggctgtgaactacaaacagcagcagcagcaacaattcgtagtgacatccgcgaacagtgctagtaatagtaacgttttacttggtggtgtgagcaatataggcaatgaatcaaacaattccgtcgttatcggtgcccaacaacaatcggtcggtagtggagtgagaacacagcaaagcattgcaaacattatcggaagtggaagtaacaataactcgagtgcaagtggaatcataatagccaatcaaatcagtggaagcagtgtaaattctggcactgccaatacgtacattcatcaagcgtcaggtggcgttgtagtgacaggaacagcagcagtagcaagtgcgggccttacagtaggccctgtcgggtcttcggttcccgtttcgcctacggcccggaagcgcctcaaattagaacaaagtcctattgttgacgtggaacatgacattgccacactcaagaaactgattctggagcacaaatatatgagattacggagcattaaagaaaagtaagtataagtgtgggaatctgggagggaaacagataagacggagatatacttcacacgaaacatgaaacaacggttttacaaacatcaagataacttcaacaataattattgagacttgatgaaaaagtctatctaacaaaaggggattttttttattatcgtacaaattgggccgaagggtctcagattttcatgaaactttttccacaggcagggctcatggatatatgaataaaaaaaaattgagaaaaattcagggtcgcctatttttccggaaaactctggtgaaaattttttgttttcccttgacactacttactttgaaaaatcataactcaagaacgaagcatcgtagaaacaaagtttttatataaaaatttaggcaaattttctcaaaaatccaaaaaaaaatatgaactggaaaaagttttccacaaaatttttcaccgttgggaaaatttgtaaagaaaagccggaaaaactatgcccgaactcgtggaaaattttcaaaaaaatatttttgagaaggaaactttataaacttcaattatagtaacttttaggatgtacttttttttgttcctgagttatggtcaattttgtgaaaaatgaccatattagccttttctttgaaaacaaatctttgcattttttacaaaattgaccatagatcaggaactaaagaaaagtacatcctaaaagttaccagaattgaagtttataaagattctttcttaaaaatatttttttcaaaaatttccgcgagttcgggcatagattttccagcttttctttatgaatttcctcaacggtaaaaaaaatttgtggaaaactttttccagttcatattttttttggatttctgagaaaatttgcttaaattttcatacaaaaactttgtttctacaatgtttcgttcttgagttatgatttttcaaagaaaagtcttatacggcacatctggacatttttcacaaaattggccataactcaaaaacgaaaaataagtgcattccaaaaatttcagtgattaaggcttataaaattaccttctcgaaaatatgtttttgaaaattttctacgagttcgggcatagtttttccgtcttttctttacgaatttccaacggtggaaaattttgtggaaaactttttccagttcatatttttttttggatttttgagaaaatttgctttaattttcatataaaaactttgtttctacgatgcttcgttcttgagttatgattttttaaagtaagtacagtgaaacctccatgagtcgatattgaagggaccatcgactcatggaaatatcgagtcatggaacagcaatcctttggaaagtggcttctagggaccatcatagtaaccatgaaattctgtttttagtatggttccatgagtcgatatcgagtcatggaacatcgactcatggaggtatcactgtagtgtcaagggaaaacaaaaaatttccacctgagttttccggaaaaataggcgaccctgaatttttctcaatttttttttattcatatatccatgagccctgcctgtggaaaaagtttcatgaaaatctgagacccttcggcccaaacccgtacggtaataaaaaaaaatccccaaaactcaattgatttcgaagtacgatcaaagcaagcgaagaaaaacatcgcatctgtatcggtccatgatcggaaatatttcgcaagttgtaacctgagagagacccgcgaagaggaaaaatatcaacgtcatatgcagcccagattccgctgtcacgaaccgtcaaatgcagcccgccgctttatggctgcaaaagtgaaaagtattgaattcaaaataaactgttgttaaaaacctcagtcagcggagcagatttttccaaagttgctgataaatttcaacacaagattagttatttctaatgtctgctgcgtttgctgacataaaatttactcaaaaggctatttaattatgattcggtgtgacgcaaacgcaattttttttttgctgagaggttcatgtgagggtttgaatggtttgcgcatgattggtatggaccgatgcacgagtgttcactaatttgacgtttaagcggtgccgaattcactcgttgccatggtcacgtaaatacacggcaccgctcaaacgtcaagttagtgaactcgtgcatcggtccataaacacaaaagggaataagaaaaaactcagcaatcacagaaaaagaagaccgtcttcgcgagtctcgtctcaggttgtaacaaggtttataaacagcagcagcgaagaaaagtcccaaagagagcgacgtaaaacccatatttctcgcttattcattattgggggtagatgttttacactactggcaattcaacaattcccgaaaaatacaggaatagtgtccccaggtttgaagcttgtttagattgtatattgacacatatattgagttgttcttcggcaatcctatccgcttctttttcttcttgttgtattaggtccccactgggacagagcctgcttctcagcttattgttcaatgagcacttccacatttattaacactgagagccaaagttgccattttcgcgttcgtatatcgtgtggcaggtacgatgatactttgtgctcagggaagtcaagggaatttccattactaaaagatcaaatggccagcctttccggtcccatctctcatcggttcagctccgataccatccttaccagcagctttattgctcttgagctggtgaatgacatccttaacctccctcaaagtgagggctgattggtttccatcgcccgcagtactgacgaaggcattttttcagttgcctcgaccttcattgcctgtgctctcagtgccattcgggtgttcatcgaagtgctgcttccatcttccaggtgctcccattcttatccctgcacatctcggctcacagcacgaagccgttgcgggatgcgttagctcaggctttggaaaatttagagatcattgacacacgagccataatttcatctcttttatccgcctgcattcatacaacacggatgaaatttatcgtttgtggaagataacgagccatgaacgaaagcaagacagacacacaccacccactgtttggtgccgattactgtttgtcactacttgtaacattcgccgacacactatcattctgatcaagaacagaggcgaatattttcaattttgtgtggtgtttgatgatccaatagatcataattaaattacaaattgaactttcttgcttataatccctcccctaaatttaatataaaaaagtgtaataattaggttgttaaagcctgcattaccagaaaatatcaaagttattatcaattttatgcaaaacataaatcacccgaatggctcgatactgttgtagtctgtgagagtggtgctctagaacgctctcgctccacgttccaaacgagagagtgaatgtttacattcatacacactcagttgagctcggctaattttcattcttttgccgagatccgcacagccgagcggtcagcaactgagttctagctgatatgtcagcaaaaaatcaagtttgtttatagcagcacctgtgggtgccgctgacatcaaacgtcacttttgctgagatgtcagcaaacgaactttaaccgagatttgcacagatgagatcggcattctgatttaagtgtgtagggctttccgattgcgatgtgccacgaactgttatggttcacgagctgttacaatctctgaatatagttcgatcgccctattcggatcaacattcaaacactggttgagcttctgatagaacatacgtgtttcttgagaccggcgcagttgttccatctgcatcatttgcactccgtttcctccaagcggcgtttttttctcccaaaagaggcgggtcttgtgttgcagtttccgtctaaaacgttccacgttctgccgggtttcttgctgcatcatgaccgccagcgcatttttctcctccagtatctgcctacattcctcgtcgactccgtcccacgtacccgacattgctcttagctgcatcgttgatggttgctttcactactccccagcagtcctcaagaggggcttcatacagctcaccctcttttggtaatgcagcctcaaggtgctgcacgtatgcagatgcgacatccggttgcttaagctgctctaggtcatacaggggcggccgccgtcaccgtacgttgttaacgacggagagttttggccgcagtttaaccatcagcaggtagtgttctgagtcgatgttagcgccacgataggtcctgacgtcgataatgtcggagaagtgccgtccatcaatcagaaagtggtcgatttgtgattctgtctgctgtggtgatctccaggtgtatcggtatggtaggctgtactacgattggcttgaaggcggcgacattaattagtcgtaagccgttttcgttcgtcagccgatgagcgctgaactttccaatagtcggtctgaactcctcctcctgaccaacctgagcgtttagatctcctatgatgattttgacgtcgttgcttgggcaactgttgtactcgcgttcgtctttatcatcatcagttcttattaggggggtccgtagccttgaggttacgctttcgcttcataagcggatggtcatggattcaattcccagcccctccaaaaaataacccgtccagccaccagaagcgccgcacggaggaccgtgcataggggagcacatccatcttccgtcagtatcagatggtgactgagacaaactgacccacttcgcaggcagctagcctcaaacgactcaggaacacggcaaaacgaaccaccgcaagagcaatggactatggcttatggaaatcgattggaccaacagcagagcactctcctacctgctcggtgtgagagcaaaaagagcaaaagagagtgaaagcagatgtttatgtcgtttttgattattcccgacggtgcaccgcgcgagtgtaacaattgacaccggaaaatagaatggtttcggtgcaatattttgacagcctatgatggtgttagtgaaggcgtcaatcaaaacaaaatgtcattcttcaaagaggtaaaacagctgtttatattcttcatgatatgctgtaagggatttggaaacattagacttgtttgtgttttttatagtttgttaacggtgtttacaacactggctgaaaacattactatgccgtgaatggatataaaagttttgtttacaaaaataaatttatttttccttgaaattgataccatgacatatgtttcgtattccatcaaatttgtttaaaagttagaaatttcacatttcaacactgtaagggcttatctgacttcataaatcctctcttttgctgaaaacttcaccaaaaatcatatttccgcaattgttctagtttagattcaaaatactgcgatctttcatcgtacaacactaaagtgtttcgagaaatgaatcatcttattgtaacaacgcgaagcgagcatccatgaaatgaaatcgataattgcatcaaaaccgtaataaaaaatcaatgtcgatttatcgtcaatttattattttagcaaaaatatagaacaacagattttgcaatccgagtttaaaatataggaacatacagtttcagtcgttaataactctgccacccgagatttctcagtcaaattttccgaaaattgctcataaaatgctttgtacagttgtatctactgttatacatgtaatcaaaatatctgaaaaagagttccattttctgacataagccgaaaaagttccccttcgtaccgttgaaacatactcatatgtcaaagtatcttcaattatacttatagaatatttatatcttgtagttttgttcattaaaaacatttctactttcactgactaaaaatattcaattctgaaataaatccattctatcctcgcagacatgagcgaaaatgaagaatcttgcttcttcgtaaccgaaaacaactggcagctaagaaccataaatatgtattggtaaaaagagtgcattacctgctacacccagctcgatcagggtgtaggattttctgcaccggtggcgatcgagtgtaaaaacggtgtgctacctgcggaataaaagaacggtttgggtgcaagttttgctacaccggtgggaaaacggtgcaggcggtgcaaataaagaacaacgacattagttaaaaatagaactgtatcggtaaggaagatacagataaactgattgcggcacagtagggccacgagcacggagttccttaaaaaaaaatgatcagttcttccgaagtgagagctgtgcacgtttcggcctttgatcctcaacttgcacattctcttattgatctgccaccatccgatcacgcgcctctgcatatcacccatcattataaaagctattcccagctcgtgtgtgttgtcaccagggcaggcaatcgtcagattcgtcacagtgcgatgacgaaataaaataagacatcgtcatccagtataattctggcaggtcgtcgtctcgtcatcgacgaaaaattgcacgactaacttcaatccaaaatcgtcaacgagcaaatttttcttcattccgcgctgtccttacacacaagaagaaaacgtttactgtatattcgcttgcttcgcaccaaccaacgaatgtcatcacataattgcttatattggcaaatggactcgctctccccatgattctaaaattgctctgttggtaagcgcgtgaaattgacaattcagagatcgtttgatcgattctagtcatgttttgttaatttgtttttgttatatttaaaaaaaaaatgggcttaatctgtcgaagacacgattcatatttttagtcggctcagtgctcccgaacgaagattcgcccgtaactaaggaatcgtatttgttcgtcatcacgccgaacctatgtgatcggatctctgtggcaaatcgtcatccgacgttggttgagtgacgatgacgatgtttcttttagtttcgtcgccgactttttccatttcacggtgacgattgtctagcctggttgccgcagctctggtggatggtatgattaactctaaacgtttgcaccattgattccttccaacacaattcctgcaaagctacgatgccgaatccgcggtccttcagcacatcggcgagaataagtgtgctcacgattaagttgagagatttacagttccacgtaccgagcttcaaatcgctagtccctttacgtcgctgtggtcttcgccgattgttccggttcgtattctcttgttggttgttcgttacttgatttttttacggctgacttgcagggacaccaaccccctagattaggaccattcccccttacctgatcttgtctaaggttgctcgtaccccggccagtaccacgaggaggtaggtataggagttgctgggcaggaggctaaagaccgcacagaggggtctattttacttcttcaggcatgcgaggtaccaattgtacgccatgcccagcatttgtcaaccaacctttgaatagttagatattataaatgtcgtattataagtgtcgtatgtaattaatcttctaaatatatattgtactgctagacaaaaatttgtatagttttaagtgagagttgtaattttcccccttgtggagatgcacagatattttcgctctctagaagcaacaatcattacacacataacattgcttacccatcccaactgactgtaaggacttggccggcacctttattgatcaataacacagcgtaaaaaaaattacatttctgcgtgtctctaaggatcaaattatgtgtctcgagtagatttggggttgctgaatctgatgccattttcagaaatgtttcagcacgtcacaatttttagctacaggtcgccaaagttgtataaaatactggttgtttacataacatttaaagtataatttatcaaacatttttgtgatctaatcccctaagtatcctattttgcacttaaactttcattttagattaaatttggttgaaattgcgcgattaaatctagattaaaccgataattttgacatgcttgctgtctgcatacaaaattcttcgtttctcttatatgggaaaatacctacaataaaccaacaaaataaaatatgtttttgcaatttctcatcataataggctgtttttcatcacgctaatctgttatgaaacggtctactttcctacactgaagtatgcagtgcgggaatagccattacgcaactgaaaccagtgctgtaatgattcattacgcaacgctttctcattacgcaactgtttttcgttgcgtaatgaatagtaacacaacattttttcagaaattgtaaaataattatgaatgcattccgatatattttctgataccctcaagtggtcttctacgaaactgcactgcacttacgactcgtgctgtaaacagtgttgttcagactcatttccccgaaaataacattttccgaactacgaagccacgaactactacaaccatgctctatcctcctaagatagaaaagcagatgtttaagcttgagtactgcacacaaaatcgatcaattttgatcccagagagccacaattcaagtttcggtgaaatgaaacgagtgagtgagtgagtgcgaatcatttcaccgaaacttgaattgcggcccaccgaaatcgaaactgtcggatctcatgtgcaacactcaagcccaaccacctccccctccatctaaggaatacaacgcccagttataacagttcattgcttcacaattcgaatttcggggaaatgagtctggccaacactggctgtaaaaatcatcattctgcaacttattccgtaatctactatttccgcatcgaaagaattataaactttgccgataagtgttattatacacataaagtttgaattctgtggcaaattaagcaaataaattgccttacaagctggcaaacttgcatgcaagttggctaaaatagttatttttttgcattttcaacagccaatatctcaaaaactagacgcgctatgatattgttgaaaacggcaatggattcagcaacccttaattgagtgaatagcggtgttttggtgctcgagacaaatacgtgttccgcagtataataagagatctgccaaaaaaatgcaacttgatggtgtacttgattgttgaataattacatgttctgcttcaatgatgaatcaattacaaacgtctgaaaattgatcaattccattctggaagaggttgattttttccagatgacaatcgaggcatttgtctgatcgaagcttaatacctattgcgactaggttcactacctcattgctctaagaacatactaatcttcttttttcctttcttatttctcatatatcaggtactctgaacatgtagcggaactgttttttattcagtccggtggtactatgatggattatcctgtatggagaaagaagccacatacgcccgcgtttttaaactttatgagaacgtataagctagaaccgctatcatccaatctggaagaagcaggagaaatacttaaacaggttggttggaaatttgcggatcatctctgtccaaatgaattacaataatctgtttttcagcaatcgagtcgatcgctatcgtcatcgctgtcatcggcagcaagcagctcttcgagtttaccacaaggcgcagaaattaaaattcccggtgtaggagcgacccccgtagccgtgtcgacgcaactaccggccgcagtggctcagctgagtcagcagggtaagtttattcattttaatcaccgatgttattcactgaaggcttttcggtttagtttgatttatttattataactcatgatttgttttgaacccttaatccattatctctcactcattacccacattttttgacttttttttgtttgcacacgatcatcacattgacattgtttatgttgagttggtaatttcatcttctcacatgtttatcctgtaaatgcattccaatctcactatcaccaaaccgagtaaacgtaaagcgcttaacatttgcaagataggattttaaattagagtttagtttacaagataaacattgaacaagagaaccgaattagacgacttttcagcaatcagttctaaaatcccttttcttttgggactgactgagcattgttacggtcgctcccgacgtttttactatctgggtcaagtatttttgttgtttccgcaaatctattctttttctcttggctttcgtctcttttctccctcttgtgtacttgtaggtcacatacccggaaggcctcagggaggtcgccacgggatggtctttggtcagattagcgtaccacctgtggtaggaaacccctctgtacctctggtgccaggttcgcaccgttccactaacattataaaaaatcaatttagtcgaaacataatgtttagctttattgttttctatcttaagttcaacaatcaacttgctcgtaccgtcaaacggggtaacttgcaacactttccaacttcaaatctatttggacgaaaattttaagcacttagatgaaccaaatacaatctggtatcctaatcgctacgtaaagaatgccatgtggtatttattgtattaaaatttgttttcctgggatcaggagaggctgaaaatatgcttttttcatactacccctgatgtggggtaacatgcaacacacaatacagactgaagtttactatcaaaaatgttatcaataccgttttttaaatcattaaataattaactgcagtaaaaacatgacaataaacagaaactaggtaccatcatttttgaaaaatcattatttttgatttaactatgagtattgaccatatacggttaaaaaatcgattgattttgtattttatatgatacacaagtggaaatttttagcaaatcacaagtcttgacggctagtagaaagccatttgaaagttttagtgctactttttattcaactgcaatggttttgaggttttgcttcacataagatatttttcattcatgttttaaccaaagcaacgtatcatatattgatcgcatgtcttgaaatggcctctgttggtcattgaaaatagctatatttatatttcatgcaaaaagttcataatgacagatctgcaagttacatttgaaacatattttaagaaataaacatagttttcacgaataaaatataataaattccaataataatgcgattaatgtaacttttttctaccaaacgcgtaataagttggttgaggtttaacaattttaatgtaattctacaaataaatggtcaatcttgctttttcatgtgtttttgatgacaagcggcagaaaacatcttgccattgagattaaaattgctgttgcaagttaccccacaagggtagtcaaaaacgttttcaattattttcagtgtatgaacgtgaaattaacaaaacttttttatagtgcttttgtacactattaaatactgtagcgaaaagcaaatacctagaataatatttataacccgtttgtatggtactaggaacgattttccgccttgttttaatacgatcaaacgtgtgatatgattttctcctccagcaaaccaaccaaagtagaaataataccaaaatcctcaccaaaacctctctttttatacctaaggtcattaaccggtgtaacaaattagaacaatttaacttgatgctttagaaaacgtcaattcagttacatgtcgttgtgttgcaagtttcacccctgttgcaagttaccccgtttgacggtattagttttcttgagaagcgcatatttgtatgagtttcaactgcttttcatatgaatgattcaagcgcatcacattatcccttttctgttttatgccatgccatttttaacacattatgtttatttcaaaataagtatttgtatatcgagtaccaaatccattacttattgcttcacaaaattaaaagtattatcagattcatttagtacggatagtatgatagctaataattgaatcgatttggtacactgatatataaaatcttcaagcatgctaaagtttgtagttctaacaacatctccattctcacctccaaaaatcatgacgctttcagtttgcttaattgtgtatagtagtttatcaacatgatgacttaaatactgaatgtttccgtttgtctcgttttgaggcagaagaaacttttataagatgacaatcgaggcatttgtctgatcattttactatttctaaatcagtgtctctcgattttggctattgttttttcctaattcttcttatctcaatgatctttcgttacattcatgaaggcggcacccccattattccggatccaattggaatcggagccacgcccaccattgagaagcggaagcaaatctcagcaacttccgtcacagcgacgagttcatcgtctttaggaatctctgcatcgatcagtggagcggtgcaagttgcaagtggtggttcgacatccggaagtggaaacagtgggaactccaatgcacagcataatggaacttcctcgaacactacaaccggtggcaatggtcaggaacattacacaaacaaagccaagcaagaggtatacgtgatgcagcgaatacaggaacttcaaaaggagggcctatggagtgaaaggcggttacccaaattacaggaacctcaacggcctaaggcgcattgggattacctgttggaggaaatggtttggttggctgccgactttgctcaggaaagaaaatggaagaaagcagcggcgaaaaaatgtgctcgcatggtccagaagcatttcctcgacaaagcaatggcagcccaacgcgccgagaaagcccaagagcaacagctgaggcgaatagccggttttgttgcgaaagagatcaagatcttctggggtaatgttgagaaactggtcgaatataaacagcaaaccaaactggatgaaaagcgaaagaaggctctagatcaacaactaagcttcatcgttgaccagaccgaaaaatactcccaacaattggtggaaggtatgaacaaacccaaagcgattcaagatcaaaatacaagtaaggccaatagcttaaactccagtcgagtgccttcgcctcagccgaaaaatgcttccgacgacgagttccgtccggatagcgagatctccgatgacgacgaggaaacaattgctaaggcggaagcggaagccaccggaactaacgaagaagtgttggcactgcaaaaggaatctgagatggatcttgatgatttcctgaagaacttacccaaggattacctggaaaacagggataagatcgtattgtctgtaagtaaacacgtgttagcacaattctttctgaattttatgcatataatgattattgttttgatattatttaaggaaccggaggatagtgaaaaagagagcgaggacaatgacaaagatttctccgccgcagaaaatagtactgatgatgaggatactattatggagcaagagaaacaggaaaagaagcaggaccataagaaagaaatagatgaactgaatgtaatatccgggtaatgattttagtttcgagaggtttattcacgtttcatttatttcaggcggaaaacgaaatgagcatagaggagttgatggcaaagtacaatcgaccacctccaccgggccgccgtttggaggaaaaaatggatgtcgactccgacgatgagcaaagcgaatcagaagcggaatctgactcctctgaagaacaagtttcctcatcggatgaagatatggacggcgatcagggagacaaagacgaagaagacattggtctgaaaaacttattggacgatgaaatggcgagtaaaagtcaaagtgaaaaagatgaaattttaaacgatgctgccgccattgccgaaagtattcaaccgaaaggaaatactctctcgtcaactagtgttgtaacgccaattccgtttctgttgaagcacacccttcgagagtatcagcacatcggtttggattggttggtaacgatgcatgatcgaaagctcaatggaattttggcggacgaaatgggtctgggtaaaaccatacaaactatttcgttgttggctcatttggcatgcgtgaagggtaattggggaccgcacttgattattgtaccctcttcggtaatgctgaactgggaaatggaattcaagaagtggtgccctggattcaagatacttacgtattatggttctcaaaaagaacgcaaattgaagagaacgggttggaccaaagtaaatgcatttcatgtgtgtataacatcgtacaagctggtcattcaagatcaccagagcttccgacgaaaaaaatggaaatatctcatcctggacgaggcgcaaaacatcaaaaacttcaagtcacaacggtggcagctgctattgaactttcaaacggaacagtgagtatgacaaaactaggaaaaccttttcctctttaaagcacatttaatgatgataccattactaaaataactgatcggattcgaaagtctgttttagaatttcgaaactgttctacagatgacaatcgaggcatttgtctgatattttgtgttaaatgtgaaaaaaacagtcctcttacaagaaggtctagcaaaactaacgaatctaatgtatcttccacagacgtctcctcctgacgggaacgcctcttcagaacaatctgatggagctctggtcgctgatgcacttcctaatgccgcatgtattccaatctcatcgagagtttaaggagtggttctcgaatccgatgacggggatgattgaaggcaactcggagtacaacgaaaacataatcaaacgccttcataaggtctgtaacctgtacgtaatgtagtattatgattattatttccacgtttagtttatttgataggttgtgggtcatgaatttttttagatttcattataccttggctgtaccaggctgttcgtccaagcgagcgtcaaaatagtttcctcatatacaataccctacccgccacaagcatggaatcactttaccgagtattgcatcactctatttgaatattgtaacttccccataaagtttagagtcacttcagcagcatttaacgtaatgatttccataagccttactagaaggaggtcaagaatggtctgccccgtttggcgtaaattcatttcacatgaaagacgtttggcataatttgctttctattaatagacgtctgagttgttagacatattgagtagtgtgggttttttttttcatttcgttgtatgctcctttggggtgcgcgacggaatcaagaccaatcatgttcggttcgcgttgtgagagaacaaaaagatatgcacgttcagtcgagctcgttcagtggtgagctcgtttcatgctaatagtaaattatttttatcatttctgcgttacattcatgttatttttaaacagtctccatctccatagaagaattgtcaaagtgcttcaaaatcagctgatttgaaacgtcttgtgaaaaggcctataatgccaaacgactgtgtgtcatatgggggtagccctttctatcccaaagctttgtccaatgattgtcaaaacggcgtttctggaaagttattgagttgcttgaaataagattcacctgtgctaccatgaaaaagagagagagtttaaagtgaagtttaaaggtttattttatttttggcacttttgattcacttctccagggatttcttgaaagttactgaactcaaatttggccaccatatgcgtggcattgaagtgcttcttattgcaaaatttcagaccattcgtccaaacctcttacactaaagtaaatcatatcatgcccaagtagttctttactctaaaacgtaaaaaatgaatactaaattatgaactaaagcatactggactctacttgagacatggatttgccaacattttcgagctaaattattgaatgttaaatcgttgaattttgtatgaaaattgggaaacgtgtgattgctacaacactgctatccataatgattcaataattgttaataaattatgattaccattctttgcgcgaaaaaagtacacagaaaatcattacaatggccatgtgatgcatagaattttcattagaactttgtaccttccagggattttcgtcagttaattagataggcaccagtgtttgttttgttattacctgtcttatttattggataaataatcataacttagaaaagtcaactgaatttgtacaaaaagataaactgttctatttttggtttggttctaggttttacgcccattcttgctgcgccggttgaagtcagaagttgagaaacaaatgccaaagaaatacgagcatgtcgttatgtgcaggttatcgaaaaggcagcggtttctgtacgacgactttatgagtcgagcaaagtatgttgagcaacttaaaaatatcaaacagctttgcgtataacaattatttccattttttagaacgaaggaaaccctggcttcaggaaacctgttgagcgtaatcaatgtactgatgcagctccggaaagtatgcaatcaccctaacatgttcgaggaacgcccgacaatttcgccattccgaatggagggaattaacttccggacagcttccctggtgtacaacatgttgaattatgatccctttacggttggtcattttttgtttatcgaaatccttatatctaaatttcattacgtttttaactttacagcaaattgatctgtcttccctgaaccttgtgttggtcaagttggagctagtattgtctgcatatgtggcgtaccgttcccaacggttatgcatgccgaagcgtctgattgaggagatagattctacgcctgagccgccaccacgctgtcctacaggcagactccgattgcacgtgagggtgccaaatatgcgcgttcaagaaacgatcagcaacagcactggggtccgagttggaaccagtccagccatgaagactgaaggaacgcgctatgttccgcttgtaaattcttcactagtagataggaaacctttgatcgaagagatcagttcgcaaccagccacaaatgcaggagcgatcgcactcgacgatccccaagcgtcgaatgtaaatctacgtaaacgatgtgatatgattagtggtatcagtagtagtgttagtaatataagtactcatagtaatagattcagtgctgggcacgtagcgcaaattgtgcagacttccgctggaaggcagttaattttaacgccaagcagtagtacctcatctacgcttatgacaccgagtggacaacgtctaactgtggtcaataggataagtactcccccgtcgtctacaatgaatgttatcagcagcataactactcaaccttcgacaaccaacaaccaaaatgttccttcagctgcaagccctatttcgtcgtcacttgccacttcaatagttcaacagttaaaacatcattcctattcatgtgctgccaccaatttgactccagaagagctagaacaaaaaattcgtaccgagttttacctggcaagcgtggaagagtcgcgaaaagagcgaagaagtcagattcttgaacttctgggcagaatgaaccaaaaacgatgcgattcctttccaatctatggcagtgacctgcgtgaatctgtttcaaagatattcgatgaaggctttctggacgttgacatggttccaatgatctcgataggaccgcgatactgtcaacaagcatggcgaaatgttgactggagtttaacgaatgccatcaaatccatcgagcagcgaacggaagaattccgatcggtgttgaataattttgtgatttacgtacctgctgtttgtgctccggcgccaagtatccacgtctctcatccgcatccttctcgaatgaacgaagaacaagacagggacgatgccatccgggacggattgaaaccagctttgaggatattgcacccaatcatatcagcgatgagtacgcaggtaggttatctgatcatagttacgaatgatttaattcagctcttaaaatcgattgtttcaaaggttatctttgttacgatttttgcaatagagccagagtaaactaccgagcattgaacatccagcggactcttgtgtctatcacaattggcctctagaaccttgctacagtttatttaatgcatcatttcagtggctatctctataattacctactgtttgaaatcagcttttgtcgtgatgcaacaaatttcgacttcagtttggtacggatttaatctctcatctctttttaaagtttccagatcctcggcttattcaatatgactgtgggaagttacaaacgttggatcgcctgttgaaacagctcaagtctggtggccatagagtgttgatttttacccaaatgacccgcatgctggatgtgctggaagctttcctcaactatcatggtcacatatacttacggttggacggtacaacaaaagtcgaacaacggcaacttctgatggaacggttcaatggcgacaagcgagtgttcgtgttcattctttccacgcgatctggtggcgttggtatcaatctcactggtgcggatactgtgatattctatgattccgattggaatccgaccatggatgctcaggcccaggatcgatgccatcggataggtcaaaccagagacgtccacatctacaggctggttagtgaaaaaaccatcgaagaaaacattctcaagaaggccaaccaaaaaaggatgctcggggatcttgccatcgagggtggcaatttcacaacggcatatttcaagagctcaaccattcaagacctttttacggtcgataccgtggaagaagatgcttctacacgattggcagaggttattgatcgagatcgggaacgtaaagaacgccttcagcagagtatggctgctggaacgagttctaccggagctgttgcaccgagcacaagtagtggcactcctgaggaatccgccaaatcggctatcaatgttttcgaatcagctctagcagctgcggaagatgatcaggatgtgcaggctgccaagtttgccaaggctgaggcgtcggcggatctggaggagttcgacgaaaacattccgatcgatcaagaacccaaagaaaaggaacctgaaatgagcaaggccgaaaaggaggtgcaaaatcttatcaagcaggttagtattttttttttaaattatcctttataaaatatccccgaataatgtatttcgtttttgctgattacaacagcataagcactgtcaataatatccggggaatatcatatctgacgatccagaccgctttttgtttgcctttagtatatctaaaagctatcaaagttctcggacatttgttcaattgtattttcaattaattttttcaagcccaaaagaaacaataggaaaagaaagatgatactaaaaattacgtttcttctgtttcacagctaagcccaatcgaacgctatgcgatgcgcttcgttgaagacacagaaggaacatggacagcgatacaactaaaggccgttgaagctgaaatcgagcaacagaagcgagattgggaagcgaatcggttagcccagctgaagcgcgaagaggaggccgcaagacaattggaggcagaggagaacgatcttcttacgttctcgcgggaggatgcaagcaatcaggttaataaatctagctctaatcgtagttctagtggtggtaaagtgaacaataacaacgttaccagcaaagatggaaagaaactaatccatcgaagagtcgcgatcgtaaaaaatgcccacaagggaatgctcggtaaacgtaagggatcaatttctggggaagaaggtaaagacataaatagggctagaagtagggcaaccatggctgcattagctagcaggaaagctaaaaaaatgaaattagtgcgacagagtgaatcttcagcgacaaacactacaatcaggactagaagagacagtgtcagaaacattgctagaccaaacaattcacgtaggaaacgattaaagagaagtccatcaaagagaataacacgcagcagcgaaagtaaagaagaccaggaaaataaagatggaacggataagagtgaagaagtgaaagatgtgagaccaacggatgaatttgacagtgaatgcagtttagatgtcatgattgattcgaatgacgcgccagactcggactcaaaccaaatgaataactattattcatcagtggatgatgaatcgggcagtcaaagccaagatgatggtaatcagagaccaatggatgagtccaaacagacagaggctggagcgggtgatggtgtgaatagcacccctcgtacaaggtctcgtggttctgtcaaaataaatctatggactctggatgacagtccaattcttgccgttaaaagacccagaacaggagatagtctcagaagcaaaaagaacgtgtctggtgacaataaaagtgacattcaatcgcatgacgaatcatcagctgtagaagagtctaccagcatgatcaataacgacacttcgattgccaatgagagctcgattgctacagaactgtcaactacaaatccgatcaataccgatgagttggttgttgatcccgaagtgtcggaaacaatcaaagaattgaaaattttagtaactgacgtgaaacaagtgaaacgtgccaaggtgctggatggttttgctagtcctcagaggacaccgtcgccaaaagcgagaaagcttaaaaagttcccaccgaaatcgtcgagcaatcgtacccttgacagttgggtatctaaaacgcccaaatctgccgtaaataatagcgatcacttcgattcggtggcaaatgacaaatcaataacgccagttcatagtggccgaacgacgcgagcatcccttaaactcgacgttgcagcaacacatgaaaatggagaatcgtgagctgaatctctcgtaattgggaatgacaagagttaatactaaagagttccacaatgctgctttaaacacggaaaacacatcatctatttatttaaaactatttctatcccatcgctcagtttatgcaattgttcatggcaagttcaaaataagtacctatatcttttgttcaatcttcattgtaaatagttttgccgaaatattaatcaacaattgagcaaaggttaggttttcagttgatcctctattttaagtatatttattcatcatacgcccacagtcccaaaattattgtgaatcgatacctgtttttgagtttaacgtttaagtttaatacatttttagccattgtttttttctttgactaaactctactgagctcttgctccgtagcatagatcgaatgaaagccttatttaaaagttcgtgaactaggtattactgatcaaaagactaccaggcgtgttattttcgtctgtttgaagatagtgaacaaatttttgaaactggtctgattcaaaatatagatttttgttcaaaactgtttggcattttttagtttggttctatgttttacgcagcatttcatgattatagacataattcagtgaaactaacgattgaccgtattttagcattacgaaccaccaacaccatcaggagctaacacaaaaaagtacatttaaaaacaattccaatgttgtacatcgatcaaaatctaagagattattctagccttttcaaacatgtcgcattgtgctaaatataatatccaattaaaaagaatgctaaaatcataggcccaaaatgcaaaacctaaaaaattgatagaataaacaattccttgctgcacactatgaaaacatagttaagtggtcttttgatttaaactgtctctctgtcaatatgcgtggcctcaatttatcgttcgtggtatatttggtgggtaaggtctgtatgtcgctgttttggtgtcatttaaagaaaagtatgtaaggttaataaaaaaaatcgaaacgatatccaaatctaatactgagaaaaaaaaaaagaattatatcttttttagagaaaaagagaaaagacgaagagcgctgtttgtcgtagaatgctaatttgtaccgattatgaaaactggaaagcagtggaccagtgctcggtctggcaatggcaaaggttgtagtcattactattttcttaagaagcaacgacttttcttgttggcaccaaaatattcgttaagcgataggcaatcgatttcaaacgaaacacagccttgccattccgaattgcctcggatgtagaaataaattgaagctgctgccggacggagcctaagtcagacagtttctcaagagggtcgcaaattagcagagccacaaaacagcaaggcgataatttattttgttaatttttctgttctctgatgtccattctgatggtcgttttttgaggatcaatgtggctacataaagaataggcatcagatagtaaaaaggcgatcgatgatggcaacgaaacattcttgataaaaaaaattaacaaaatatgattatcaaagcccttttctcttattctcttttttctctacttatagatttggatatcggataacacaatggagaaaatgccggtaagtagaaaaaaataatcattgtaaactgaaaattatttctatcaactactctcaactcatggctcgcaaggtcacataacaggtcaggcaccaatctaacttgaaaacacttgtgcttaaaatgcagaactttgatttccgccctttttcgagattattgaggaacaaggcattttcaatttaaaatgcatcgttacatggttaaagtttgtagaaacctgatttataacacagcgtaacaaaaatgacatttttgcgtgtctcaagaatcaaatgatgtgtctctagtagatttgggtcggtctgatgaatccgatgccgttttcagaaatgttccagcacgtcacaatttttagctacaggtcgccaaagtagtgtaacactggttttattgacgtttacatcatatttaaacaatgatttattaaaaaaaaatatgatccagtctatcaagcatgccaaataggactttaacttttatttcagctataatttggttgaaattgcacgatttaattaaggtaaaaatttttcaacatgcttgcagtctctatacaaaattcttcgtttcttttagttatatggaaaaattcaatgcttttccaaaacaaaaaaaaattgtgcatcggaagtattatgaacttaagtgataagtattgttatacacatgaagtttgagttctgaggcaaatttagcaaataaattactatacaagctggcaaacttgcatgcaagttggctgaaatagtcaaatttagcattttcaacagccaatacctcaaaaactagacgtgctatgatatttctgaaaatggcaatcgttaattaagtaaatagcggtattttggtgcttgagacaaaaacgtgttccgcagtgaaatgcaagggctagcatcagatctctttttatagtctgtctttaattactattttaagggggaggatccgtcattgattgggccttccttagccgagtggttagagtccgcggctacaaagcaaagccatgctgaaggtgtctgggttcgaatcccggtcggtccaggatcttttcgtaatggaaatttccttgacttccctgggcatagagtatcatcgtacctgccacacgatatacgaatgcgtaaatggcaacttaggcaaagaaagctctcagttaataactgtggaagtgctcataagaacactacgctgagtagccggctatgtcccagtggggacgttaatgccaagaagaagaagaagatccgtcattgatttcggaattttcaaaagtagtttttgcgttcaaaatcaagaaaatttcatcgaaaatgtgttcactgtaggttagactggcccttaaacaaaaaagttgtaaaattcaacggggcaccctctagatatgtgccttagggtaagaaaaaagctctctcaaaatctcaactcatttggttgctcccccagctggcgcattcaattcaaagtttgtatggaatattcgtctcaaatatattgaaaatttaccctatgtcactgtttcgtctcgtacactagttaatcgcgttcaattgagcccaaaatgacaaattcactagttgatacgctaatgaacatagttaccgaaggttgtatctggatttaagctcattttcattaagctttcagttgttgaaagttaggcttagatcagcactcccgtacacatgtgcatgcaccttgtgccgcagctcgcccagcgtcataggtggctatgatgcgcttagtggctaccacccagctaagttgaagaaatactaagcaatattgcaaatctacttcagataatcaaaacaccaactttatcaattttaatcatcatacaaccatctacaatattgtttgctatagtatcaagtagtgtttttgacattctgggttcaattgaacgcgatcaacaattttcctgactcaaacaggagatgatgtgctgtttcctatatgttgtagctgaaaatcccatatgaactttaattcaattgcgccagctcatggaacgaccaaatgagctgaaactttcaggaagtcttcctctaaccctaaagaataatcctggcgggtgccccgtggaattatacaactttatttttttcccatactaaggtgggccagtctactgtaggtctatttaccaaccgaaacacagtgaacacattttaatcgaataatcttcagttttgaccataaaaactgcttttgaagtttcgattatgacgatgacggatcctgcaaacgttgatgcaagtccctgaaaatgtcataagttttagttgaaggtgtctaatgtttctttaaaaaacgttgatccacatggattacaatcaaaactctctcataattttcttctgtcagtaaatcttctaccgatttctccagttttaatttgcctaaaagctgacaaaggttcatttcattctagggttgaataaattcgcctaggctgaaaattctacaacaatacctcgaagagttcataaggtgttttccataaattatattttcatagggtttccttaaagagtttctccatggattctcttccatctaaggattattccacgaaatctattaggaattcttccatgagttcctcgaagaattcgatcagagattccttattaagttcctacaggaatttcctccagagatttaaccaacatttcctgcattctcttcctattttttctcgagtaatttcacaagtagtccatgtattcctcgacagtactatttgtgtttcacaccataaagtgttgcagcaatggaccgatgcacgagttcactaatttaacgtttgagcggttcatcataaatatccagataaataacacggcaccgctcaaacgtcaaaaaatgaactcatgcattggtcctttattcctgtcattcatccataaatttatccaacgaaaacaccgagacttttcaaggattccttcaaaaaaaaaaggtacttttcccaatatttgtttgaacttttctgttcattgaagacattcccaaaggtgcagaagttccgtcacaaatctttgcttaaggagttctttcatacgctagtattttaccaggcatttcattagtgatgactttaggattatctttgggaaaaaccatcccgaccatacctcacacttcaaataatacctagacatttttttgacaattccttggagaaaatttttgaagaatatcacgataaattttttgaatacagtcacccacagttatggatagcacacagatatgaatcagagttggattaaaatgggaatatctcatcaaacagagttgtaattacgcagaacacattttacctacgtgaaccataaatttgtacagcatctcaatcaattataatatgcttaagcatatttttttccgtccgtaggaaataaaatgtaaccgatttcccagaatcgttgattcataactgtggggcatcgaaaaccatacaacaattcaagcgtgtactagaataagggcgtaagtcgcatgttcgatttctcttcatcgatcctctcttctgtgaataaatgtgacaagatgtgggtttgttaacatttttcacttcagaccgcttggcagggatgcaatctcgcgtcttgagctgaaaaaatgctgacaaacttgcttcttgccacctttattcgcagaagagagaattgatgaagagaaatcgatcaagcgacttacgcccttattctagcccacgcttaaattatgaatcaacgacaaggcaattccaaaacaaacgccaaaacgtatgctttcactagtacaccattcgtttacctcgcagtttaattgctgttatagtgctttgatccataatatgagttgatttgatccataatagggtcctaaaggcctgtcccaattttaatgccaaacgcttaagtttaggctaaaaacacatgtttactcaattttttaatgtgtttcttttgtttaagttcaaaaaacatttttttagattttgtcacactccttagcttaaactcatatttcgggtgtattttgctttccgtgtaccttccgaaatgtcagataggaacaaccccagtgttaaaactaaatgccctgtggtgtttttgtcgattaagcgtacgtcaaacatgatcaaaaatgtcaaggttcatttatggacccaatttttaaattaaagtttaaatatgatgtagccgttatttgagcgggaaaaattgctaaaatagttgcagtaacatgctctttcgtgtcattaaataaaaacaagatttcattaaacattttaggacccaatagggatcatcctctcccactgatccacatctgtggggtggacatcgtttggaatttccaacacttttttgtaaataaccgggaatttcgaggtgtattctaaaaaacaactatactctgcagtgccagggaggttattttgttttgtacagggtcaccatttttttttaaatcatgttgttctgaaaaatgacccttagttgatccataactgtggggtgactgtacttctttgggaaatttcttggagaatttgttgagaaattcttggagcaacgtaatgaaagtattattcttcttcttagcattacgtcccactgggacaaagcctgcttctcagcttagtgttcttatgagcacttccacagttattaactgagagctttctttgccaaaattgccatttaacgtattattatagtctgtaatcatcgcagtctttaggttcaaccaggaccgactgaggacttccttgagtaattcctggaagattttttagaggatttcctgaacaaatttatgaaggaatctttagagaagttattgttatttctagagatatcatcgcaaaaatcctggttgaactcttgaaggcattgttttttctttctttcaaaatggggcattagtttatgtactagaccttcatgagctgagaggagataccatatctgaaagttttcctgtactcaactatttcccctttttctctgccatagatgtggtgcccaccaacaccaccgcaagatgacaatgacatttacgtggatcatgcccttggattcctctacgaaacggaaattattcctgaatctcaactgccccccgtctatgtgaaaaaagaatacaaacgtagtcgatctgaagctgggttctactcggatggtcgtcgaccgatcaagatccgaaaagaggatacatattatgcgccacgctcgcttttcgatcgtccttcgccgcaaatagcgaaactacgcaaagattacaaactacagagatataagggcattattaaacctttccctatggtgggtttgaagcaaacgccggttataaaacaacaaatagaaccggagggcatgccggaatggatgatccatgaagatatggccatgttgaacgtgatccagaatcttcaaggactaccactaaatttgatgcttgtttcacccggccacactccaaattgggatctggtcgcagacattgttaatcaaagctcacgaacgtataggcttccaaaacagtgtcgctaccgatacgaagctgtaatcatccctcgtgaagaagggaaactgcttgaaagcccgaagaaacaaaagaagaacaagaacccattgaaacagccgccttcgaagggaattagagcaatgcgaacttcccagctatttactggagatggaaacagttcttttattaagctggcaaggttgaagttcgataacatcaagctggcgttcagtaagaaagctccgcatgcaaaacaggttacggctaatccgcaaatgaaaaatccgaaacatgcagcagtattagcagaatacggtattaccaattacgatgccccactgacgccagtggaaattgcgacacgtcgtgcagaacgaatatcgaaggaaaagcagaagagtgccgtaatgatgcagggtcaagaacagcaacagcaacaacaactagctcaacaacagcagcagcagcaggttcagcagcaacagcaaaatcaggttcaagctgttcagcaagtgcaggtttgaattgttaacgattgtatttgttacataaaatattaccttgaacatttttcccagtataaagatttttttttactaatattgtagattgcatcctatagctgttcagtatcgactttgaactaaaaataaagttcaaaaaacttgtttacaataaagatgtaacttggcgtaaatcgggttgtctatccgataaatggactcaatcttaagttacacctcaatggaccaatgcacgagttcactgatttgacgtttgagcggtaccgaattcactagttgccatggtcacgtaaataacacggcaccgctcaaacgtcaaattagtgaactcgtgcattggtccattcagggacgaaaatactcaatctaccatcgcctacattaatacttgctgggtagaacttcgttgatttttatttgtttttatcctcacctcgacaacacaacaaagattggcaaagcgcttgcgcaagattgtcagtttcctttcaacctgctgctactcaatcgctttttggtaatcggaaacaaaaaatgatattcattctaaccagcttgacttttttacattccgcttcgggaagttgtaatttttgcacgaggcacactaaagacgcgtcaatataatccattccgtgcatcggatccttcattactcgtatagcagcatatttttcaattaatttgaacatcattgataatcaattttctaaacctgacacttttctgcttctgatattcaaaaacaccaacgacatacgggcatcgttgtttgtgttgcccatctacttttgtgccatcttcattggtacaatcatattggtggtggtgcggttactttgatggtggcataaattcagtgaattaagtatagtgagcatgatttttttcgtccctgccccaattttgctcatttggaaagctactcgtggaagataacgagccatgaacgaaaacaagacaggcacacaccacccactgtttggcgccgatctctgtgtgtaaacatctgtaacattcgctgacctactctcattctgatcaagacacagaggcgaatattttttattttctgtggggggggtgatcaatggtccaatagattataattatgttgttagttattgttgcagtctgttaaagttgctgctcttgaacgctctcgagccacgtacacacttagatttttttcacgagctcggctgtgcaaatctcggttttccgattttaaccgagactcagagcaatttgtccggttgcttagcaacgaaacacgatttactgatactcaacttttatttactgagatcccaggaaattagtttgccgacttctcggctgtgcggacctcggttaaaattagccgagattcggcattccaatttaagtgtgtaccaaacgagaaagtgaatgtttacattcatagggctctccgaatgcgatgtgccacgaactgttatagttcgcgaactgaaacactctctgaatatggtttgatcggcttatttggatcaaatcccaaccctggaaatatggaaatccaaaatattcatacaaactccaaaaaagtaaataaaaaaaatgctgataattatctcacgtaattaatggacaacccccaacgaattgttcaattttactttcgttccatgagctaaatgacgtttgaagcattttagatttgagtaatgagtaaattaacaaggtgtaaataaaaaatattttcagattaaatgcggtcaaatcagcgagggttcgctgggtataccatgtgcttcggggtgaagccgattttggtaacactcaaatgcatatacaaaaatatgtatcatgggtcagtcattaaccctgttaatcttaatgtttctgaaggcccttttgaggcataccaagttcgaaatagggtaggtgtaccgattatggatgcaataagtcaacagtatggataaatatcagattttaaaccacttttctaaaacgtaagcatgacttgtaggtgttaattactagtttgaagtcttgcgaaacagatgaattgaacaattgtagcactaaattggctgaaagcttctaaaaaatgtttaaaaaatcgttggttttgtatcatttatggcaatagtgtacccaacatttgacatgaagtgttccaattatgaactatcgattatttgcacgaaatcaatttgaatgccatccagagagattgataatgcaaggataataagtaatgtagtgattgcatataacattttccagatatattgcaagaagagcgaaaattaaaaacaatgaacatcgctgaaaagccttttcaaccatgaagacagcagctaccgcttgggaacattatcatacgtgtgattgaaacatctcacctcacacgccgcgcagaataagcacatccatttgacttgcacggcgagtcacttcactcgagtcgaaaattgtcacctcgctatacgagaccgacaattgtcacctcacgccactcgtagaacaaacccaaataccttaccgaaccgtctcattatagaagttacccaatcaaaaccttttttttttaattccactggacaaaaatgtaaacatacagcttccagaatatcgccataattgagttctcatacattctttgcaccaattaccacaatagtgtatattaacacgatatcgtacttaaagctaagtatgctgtttcgctcaagaaaagttaagaaattccttgactgaaagggtcaagaaatttcctacagagagccccctttgaagtgacatttcttctcaactgcgtactgcgatcagaaaaaagtgattttcttgaccatttcttgggagaaattttccacgcatcgagataggcgattccttttcttgtcagtagccttaaaaccggccttaaaacagtaaatttgattgcacaccagctaaatttgttcaattgttctcactatgcaacatacattcatcggttgatgtggtgacattttgataactttcacattttaaatctttttgaatgctttaacatcaagatatatcttaaatctaactactacaactcacaaaaaaatcaaaatttgaaggcgttaaagtaattacatatggcgaaatagggaacccctatggccataactggtacacttaccctagttgtcacaaaaaaacatggttttataattcttgtgaatattagccgttataatctagtggaaccgcaaggaaaatctatttttgttatctctattgccaaacttggtacttctaccctaggtgaattcaattcgtggtcattattacggtgataaaggttaaaaaaacaaccgtttgattttggcacgtttcgttttaggcgacatgaaattttgaatgagcattataatcgaatttggttcgccttttaactgtggggtcttgtaggtgaatctagcgaatagggagtcgtggatttgatccctttcggaacacttcttcttcttcttcttcttctttctggcgttacgtcccaactgggacagagcctgcttctcagattagtgttcttatgagcacttccacagttattaactgagagcttcctttgccgattgaccatttttgcatgtgtatatcgtgtggcaggtacgaagatactctatgccctgggaagtcgagaaaatttcctttacgaaaagatccttgaccagcgggattcgaacccacgaccctcaacatggtcatgctgaatagctgcgcgtttaccgctacgactatctgggcccctttcggaacacgtggatttctattcgcaatttaaatcttgattagtataattgaaattgtgtgtacttatataaaatactagagtaattagaacgaagaatattattttaggctggcaaaaaaactaaacttaccttgttacaaggtatacacaaattccactattgttcaacaacaatttacccccatacaatgatgagaatgtcaatggtaaatttaataataatctagggaaagtgtaccagttatggttatagtggttccctatttggccatatgtgaaattttgataactttcacattttaaatatttttgaatgtttcaacatcaagatatatcttaaatctaactaatacaacaaacaaaaattttcaaaataagaagacatcaaagttatcacgtatggcgaaatagggaaccactatgtccaaaactggtacacccaccctaggtattctttgtaaacgtttaaagattaagctaattttacggtttccggtaaatgtatcaaaccttaaccgaaacagctgaaacagtccggtgatctgaactacgcacttatattaaattactggggtcggtaaaattttactgggttatggaactaccgaaaaagtcagtaaaatgaaaactgtcgccacgcataattgaaaagcaaatttcaccttgttttattttttatcgatatatgatataaaaagaaagctctctgcaaaatttcattaaaaaatctctgtttttcgatttctgacattttttttagtttactgactttttcggtagttccaaaacccagttatttttaccgaacagattgagtgtgtaacaaagcacagttcatttttacctttcaaaacaggtaaattcacattgctatatctcgagatccttttgatttgcaaagaggcgatcttcagcaaagttgttcagcggatcaaggatatctgaaaggccaacagtttgattcgcaatttgataagcatgtaaaactgagcattttaagcatgtactatcttgtaaaccacgtgagatcgaaagttcgagttttctgccaagttgttcagaaggtcaaggaaatccgaaaggcatcagtttagttagcaattttgccgctaggtggcgcagtggatattgagcgttcttaactagtactatctagtggtctacatgagatagaaagctcgactcttcgacaaagttgttcagaaagcctatggcatccggaaggtaaacaatttaaatttgcagcaaagttttagaccgcatagggaaagtgtaccagttatggccatagtggttccctatttggccatatgcaaaatttggaaaacttttacatttttaatctttttgaatgcttcaacatcaagatttatccttcattttactgctaaaacacaaaagatttttcaaaatgtgaaggcattcaagatatcacgtatggcgaaatagggaaccactatggccataactggtacacctaccctatatcctatcccaagaaatgcgcgatattgccggatccagctctgtctccaggtggaatcgtattgatgtagcgggttacttctgccgggaatggatctcacttctcccgtttctaaggatcgtgttgagaggaccacccctaccggagtcagcacgcagtcggtggctcatcatctgacaaccgtcagactgacagatgccgtccacgccagaccgatggggaaatgtcatcgtccaaattattaatctttgtattcgcctagcattgttcaagtccacatgtcgttcatattttaataaagtttttaatttgttatttgttgcgttaattgcgagtttgttattgcaacaatttggcgacgagtaaaactcaaaacggttcgcggaattttgcgtagatcggtgtttttcgcgatcggggagtaaattcgagattcggcaagagtagaggttagctgctatgtctcgcgaaggaacacccagctggggggcaaatgaagcggaagccatctcattccagcaagccctgacgcagattctcgctcaacagcagagactgattacccagttgtcccagcagatgtcagcaacacagctcggcctgaaggagctttcccgtgacgacgttgcattgaatgcgctagcaagcaacatcaacgagttccgctacgcacctgaggaggggtgcacgttcgattcttggtactcccgctactcggaattgttcgataaggatgccaagaagctggacgattccgcgaaagtccgacttcttatgaggaagctcaatccatcggcccacgaacgatatacaagcttcattcttccgaaacaatccaacgagttcaccttcagcgaaactatagagaagttgaaatcgctcttcggatcacccgtctctattttccaccggcggtatcaatgcttgcaaaccgtcaaggatgacacggaagacatagttgcgtattcgtgcaaggtgaatcgagcttgtgtggactttaaacttgccgacctgtccgaagaacaatttaaatgcctcatctttgtctgcggcctcaagtcgtcgaaggattccgatattcggatgcgactaataacgaagctgaatgaatcatcggatatcacattagcgaaaattgtggaggactgcagaagcctagtgaacctcaagaacgacaacgtactggtagaaaaaccatcaacatcaaatgtgcatgctgtgaagtacaacaagaagactcccaaacctaaataccaatcatcgggtaacggaggtagcagtagtgcagatcagccgcgttctccatgctggtcgtgtggaggaatgcacttttcaaaggactgccagtttcgtgagcacacatgtcgtgattgtgggaagaaagggcacaaagagggctattgtgcttgcttcgccgggaaaccagcaggaaccaatgcgaagaagaatgcacggaatcaaaaatcaacgaaagtggtgtccgtaaattccgtcagtcatggaagaaaatatgctgaagtgcggatcaacaacgttcctgtacgccttcaagttgattccgcgtcggacatcagcataataaccgacgccatgtggaagcaaatcgggaaaccagaggcatctcctccatcatgccaagccgtgacagcttcaggagagccgctcaacatcgcgtccgagttctggtgtgacgtgaccatcaacggtgtctccaaaccaggtttgtgtcgtgtcatggtaccggaaataaatctttcggttctaggttccgattggatggataagtttggcctttgggatgtgcctatcaattctttctgcaaccaagtcagcagcaggtcgtcgtcagaagtagcatcaatccaagcgaaattcccggaagtattcaccaacaaaatgggactatgcggcaaaacgaaggtcaagcttcaacttcgcggaaatcccacaccggtgtttcggccaaagcgtcccgtctcctacagtatggaagaagcagtcgaagaagaaattcagcgtctacacaatctgggggtcctcaaaccagtagacttctctgactgggctgctcctattgtggtcgtccgaaagcccaacggaagagtacggatttgtgccgatttttcgaccggtttaaacgacgtcctcgagtccaaccaatatccacttccgctacctgaggatattttttcgaagatgtcaggatgtcggtacttcagtcatatcgacctttccgatgcctatcttcaggtagaggtcgatgaagacagccaaaatctcctcacaataaacacccacagggggctctaccaatttacgcgcttatctcctggcatcaagtcagccccgggggcttttcagcagttggtagatgcaatgctcgcaggactcaagttcacctgcggctacctggatgatgttcttgtgggcggccgaactgaaggggagcataatcaaaacctcgagcggctgctgaaccggttacaggaatatggtttcactgtgcgactcgaaaaatgcactttcaacatggagcaagtaaattaccttgggcaaatcatggatggcgatggtgtccgaccagaccccgacaaggttgctgctattgccaatatgccaccgccacacgacgttccatcgttacggtcttatttgggagccgtaaactactatgcaaagtacatcccagaaatgcgaaagttgcgatacccaatggacaaactcctgaaagcaggaaccaaatggaactggagtgcagattgtcagaactcgttcgaccgattcaaagaactgttgatgtctccgctaatgctgacgcactacaatcctagactggatatagtcgtatcggcagacgcctcatccgtcggcatcggtgctaggatcgctcatcagttcccagacggcaccataaaagcaatttgtcatgcatccagaagtctgacatcggccgaagaaaactatagccagatagagaaagaggggttagccttgatattcgctgtaacacgattccaccgcatgctatttggccggcacttcacgttagaaaccgaccataagccattgttggccatattcggatctaaaaaaggaatacccgtttatactgccaacaggctacagcgctgggcgctgaccctccttttatacgattttgacattcagtacgtgtccaccgaaagttttggctatgcagatcttttgtccaggttaatcaacaaccacattcgccctgatgaggagtacgtaattgcggcaatcgaaatggagaacacttttcaagatgcggtgcagcaatccctagattttcttccgctaacgtataaatcgattcaggaagaaacaaaagcagatcctgttcttcaagaagtggtcaaacacgttcagaggggctggcccgttaaaaagagcgatatcagcgaatcatgtcagcagttctttctacgtaaagacggattatcagtcatatccgattgcctagcctatggtgagcgattggtcatcccgtcgaagttccacaagaaagtccttcaaatgctccataagggacaccccggcgtcgaaagaatgagagcagtcgcccgcagctatgtatactggccaaccatcgacgacagcatcgctcaacttgttctctcttgtaaagaatgtgcgatggctgccaaaagcaataccagaaccaaactgaagtcatggccggtacctgtaaaaccctggcaaagacttcatatcgattacgcagggcctgtggatgattggtattaccttatactagtcgatgccttcacgaaatggcccgaagtagtcccaactcgtcgaatcactacatctgctacgttggaaattcttcaaggaatcttcgcacgttttggaatgccggaaaccatagtgagtgataacggccgccagttcatcagtgagcagtttgaacgttactgtgacaacaacggtatactccacctgaagacaccaccattccacccgcagtccaacggtcttgcagaaaggttcgtcgacacttttaagcgaacacttaaaaaaattacagcgggaggggagtgtctcagcgaagccatcaacaccttcctgctgtgttaccgttcaacacctaaccgaagcgctcctgaagagaagtcccctgctgagctgttgcttggcagacccctacgcacatcgcttgacttgcttaaacctccagctacgtttcacaaggtggaacaaaataagcaagacgatcaatacaaccgcaaacatggagccaagaccatcagttataatccaaaagacctggtctgggctaaagtcttcaagaacaacagttggaattgggaagcaggacaggtacttgagcgagtggggaacgtaatttacaacgtttggctgcagcagaaaaacacactgatccgatcgcactgcaatcagcttcgaagccggagtgaatccgagacagtggatgcaacagaaacagaaaactccgttcaagttccactagacatcctactagacacatggggtctgaacacacagaccgagtctgaatcacagcacgatctggacagtgttccggaggagccggtacagaagaggacgaaaccgtccagtgattctcaacgaagtcatcaacgcccaccaagaagagttgaacagcatccatccattcctcgccactcttcgcgtagacgaaaggtgcctgtgaggtacgacccgttccatctttattaaaagggggaggtgttgagaggaccacccctaccggagtcagcacgcagtcggtggctcatcatctgacaaccgtcagactgacagatgccgtccacgccagaccgatggggaaatgtcatcgtccaaattattaatctttgtattcgcctagcattgttcaagtccacatgtcgttcatattttaataaagtttttaatttgttatttgttgcgttaattgcgagtttgttattgcaacagatcgtaaggcttctaaatccgccgcacgtagttaaaatttgttcgagtgcgtttggtaccgcttttgattcgagtttgttccgggaggaatttttgcactcacaaaattcacaattgtgcccttcccggttgattccgtgagcaaattacatttatatatgttatatttctctgaaaactacgtgtagaacttaaatcaaacattaaccatgattggtaattccattttcaaatgtaattttctgatgatgttcttggcgtacagtctcactcagagctagctcatcagtttagtgtggtgagaacacttcctttgcctgcttagccaacattttttgctgattttcaattgattacaagttagcagagagtttgatatatactcgattttttataaatgaataattcagttatttccaagctttcaattgagataaaatttgctggggtcagattacgccattttgcaaatgtgccaagtatttgcggcaagtagacaaaatagttggacagatctgccttcgggatcccagtatagaatccacataatcattcaaatgctagttagaaggaaaattgctgatagaaatacttacatcttcaatgccattaactaaactcgaaagaacagcataatacaaaaaatggaatatttgagattattttagtagcttttactttcaataaaaaatgatcgtagaactatgaagaacagccaatgatttaaagaagaaaggatatctgatgaaaaggatccagctataatgacataatttagtgaaatggtatgacacagaagaagagcatatcaatcaaataaagcagatactacatatgttctataacatcagcagacctaacgctaataatactctcaatctaataactatgaaaaacagccttcaatacaagaaggtcgttacgtcaaacacgtagaaaaacgatgcgcgcgcccctgtgtgtggggtttgaaacataacaaatttgaaatgatcgttaaaaaagtgatcgatgataatttcttcagtgttatgtctgtttgtctgtgttatacggctctatacattatccacataactttaatcgtttttttatcttgatgtgattttcagtgcacagattcacaactatgatgcgcctatagggccaccattgtgcgaacaatactgttgccctataaagccctttacaaaaatcaaatgagtcaaccaatcgctaaaacgattccatttttcattttgaaaatagtgcctatcgtccattatgcctatcgtacttatgcataacgtatatatgccgaaacataacgtatatatgcgaaaacacccacccgatttaatgcaatcgcacacttctattagcgctactgtacttgtaaaaacatctgcgatagctcagtggtttaagatctaggggtagtcggggcggtgtagccaaatgggaaaatgatgttcgaaaaactgcccatattgccccgaatgtctcttttcattttcatcatttgtggatgatgatgtttgactgtcagaatattcttaaaaaaaatgaatgttttaacacggagtgtttataaataataataaagttcaagtgtagtaaaaaaaataatttttagattaatgtaccgtggagcaagtgggtaatggatttcgcatagttgggattcttcagagcctagagactttaaattcaaacaaatgaggtcatgtatatttattagcttgactcccaccaaatataagccgtatgctgaaatttgtttttatgttaaattgaagaaaagagcacatacatttttttgaaaaacgtctccttactattcacttgccccacaagtggggtaagtgaaaagtttatcgttttgaacaataaattcaaaaactaacagttatattcacgatttctattacctttaacatttgttaaggcgtcccaatgaacaataatataagtaatatgctaacaaagaaaattttattcttgttacttgaattttcttatgttcaattatgtttgttgaaatgattcgactacttcataattgcaacatttccaatgttagttcttacatcatgggacagcaattgcatttctgctttgtagaatttacaccgctcgttatttgttaagaaaatcgggtaagaactcttcgagaggaatcaaacggaatcctccaattaagtatttagaaactttttatgtggatacacctataccccatttttttatgtatcgaactagctttacataggtattccagatttccgtgcgttctcttatattggaactttccaatcatccttttcaatccttttaattggctgtccgaagtaaacataataatatcgtaatatttggcaaccttttgtttagagaaattccacgatttggccatgataatagcttttaacgctttgaatatagtgtttcttgaattatcagcacgttctgatcttctatgatacagtgatacctgcatgagtcgatgttccataactcgatatcgactcatggaatcatactaaaaccaaaatttcatggttactaagatggtcccctcaaacagctttccaaagcatttgtttccacgactcgatatttccatgagtcgatggtccgttcagatattgactcatggaggtttgactgtgattgcgaaccttgtatacttatagctacctaaagagaaaacacaaattcaatttctaatgagaaacttttcacttgccccacgtcagtagaaaattgacggtgtttcaattaaggtctatgtcgaattaattctaaaactttttttattgcagtttaaaactgtcagaaaggaaaacttagaagtggtacagaaaattattttccgcaacttttatccgctgaaaatattaaaataagattgcacgccgccaacttgttacggagtgatagttgacaggttaacaatctttcgctctattatgcaataatggctgaaaaatctcagaattctcttgcctaacgtagtgttttcaatttcctccttaaacatgagcttaaagcgtcaattcccatattcagttaaatataccaattattttcacttaccccatttacccacttgccccgcggtaccttatatgagattattttacaatcaaaaatagggtgctctatcaccccatctgtaaaaaatcgactcaaaaaatgacaaattttgaaaaatcattcattcatccgtggattttataagacaaaagaagtcatgcgaatctagtgtattaaaatgttcgaaatcatttccccaattttcctgatcaaactagtgatattatccaccaagcatgcagcaaaggacttaaactttcatgtgagcatacagtttggtttaaaatgtactgttgaatttcgattttattgattttttcaacgtgcatgcagtagcggaatttggggcaagtgtgccaccttaagcaaattgttctctaactttgcccaaagcttataaaatccaccaatttagcctcatgatgatagtttcacatcttttcgtaaccactgtgccatttgaaatgaaaataattccaaaaagtattagttttggagcctctcaaatatcatccaaaataacctatttttcgacactatggggcaagtgtgccacccatatgggacaagacggccaccgaatgaacatcgcatgtaattttacttgtaatgaaattttctttatttcctattaatattatttaaaaagcagacgctaatcgataattaaaaaaataattttaagtttaccgtaataaggggaggctttataacaagattcaaaacaagcgtaactccctattactcaattcgaataactaaaatggttatttttgactccattcaatacaatatatgtattacctttatattatggcgaatatgtataatattaaagtagataagcactaaataacggtaaaatattgatgtagatatgtaaaacggtacttaataagccgaaaaacatgttatttttaaatattttgagataaaatcactttggggcatgctttggggggcaaacatgttagttattctcctattatacttcagaaactactaccggtgcctcattttagtttattattatgattttgttgatgatgtttacatttttataaatttcacttcaacaatttgtgtttaccaaataggtggcacacttgccccaataactatacatttcaaccaaactggattttgtatataaaactaaatacttttttcgttcaaatgccacaataacttacacatttgaatagtttcacgatgtacagtacgttagaaaaatctggtaataatttaccttttaccatgctatttagaaacaacaaaatcttataaaaatccactcaaatttggttgtctttgcaaaaatcgatgtaaatacgtgtaaaatagagcaatgttcatcatattttgattattatattgtgaactacgaaggaacatattgttaagctcaaagaaaaaatatatattgtagtttttataaaaagcaggggtggcacacttgcccctatggcacacttgccacaaagtccgctatctttacgaaagtcttcgcatctttacgaaataacgtacttttctaaagcatcacaaagtaacttttgagtgttgatggtattataatctttgaggataagtatgctttaatacatgaactttgagttctgttgtaaattgagcaaatatattgccacgtaaactagtcaacttgcatgaaaattgtctggaatcattaaataatgcaaatatctcaaaaacgtgctctgatatttttgaaaacggctatgaacttaggaaccctagaccaagtagatagcggtatttgatggttgagaccaaacaaatgtttcgcagggtattctttcagttgcactctacaggttctcatgatatgttgcggatttagattgagagcgataagtgagagataatacctatctcaattttaaatcaaattgatgtttttttcattttcttagctgtccgtcttgattaaaatcaacgtttcgaataacgtcagtgatttggttttaattttatgtttctctgtccataagcggcattgacttctttgattttttgatctattctaaaaactaacgatgttcaactaaaatgctcccaatgatccccccttttgaaaatgaataataatttaaatgaacggggaaatgccaagctataccgttacgttgtttgtctgctatgtctaattctgtttcttcaagatcgtggaccaaattatcaagcaatcaatggaaaatatgttcaaggtaatcatctatttcacttttccaatatttcaaattgtgcctttttacctttgtagcaagtggttcagccacagacccacgtcattcaacagcaagttccgcagcagattcaaatccaatcacatgctcagcagcatatagcaacggcagcggctggtggtcaagttcagcaaaccacaattgtcgtttgcggcgttggaaccaacacagcaccagccgtggcaactctagtgcaggctccttctatccaggctggtcgatcgcaacctgtagtgaacatttgcccgagtccaagccagcaacaaattgttaaagcgatagtggctagtccttcgaatcagaacattataacacaacagttagcagtagcgcagaacaatccacagcaacaggtgtcagttgttcttactaccccggtgacgactatgtcggctaatcaagttcaactttcgcagccacagattgtgtcgattcatcaatctacgccccagatcattcagagtagtcctgctgtaacgcaagctacaaattccattgtacaaacgttggcaactcaatctctaccccaagtggtatctgtcgctcagttggccacagtcggaacggttatgacaaccggaagtgctttacaacagtcgcaggtcgctaccttaacgacatctgctttgagggcacaaagaatagttgcccctcctggaacactacaagaagtggttctccatcaacgatcaggatcacaaagtcccactgtcgtcagcgtcagtggattaggccaaggtctaacgcaagcccagttgcagacagcacaacttcgtctatcgatggctggaggtcagcaggtttccggcgtagttgcaaagggaatatcggttggaacagttacaagcgctggaaaacccatcaacacatcccaaatacaattttaccgacaacaaccaatccgacagcagctaaaggttctgcatccaaatgcagctcaaggaggaacaacggttcttcaacaagcaacaggtcaaccaactttggtaagccctgccatcatccaaggaaatataatccaaacgggggctgtaggtcaggcggttcaagtgcaatccgctgggcagaaagtttcagttgccacagttactagttctgcagcagcaggcactacaacgcaagccggaactatagccacagttcaggttgcacctggtcaacagagaactcagttcataaaacaggttggtacaaaacaaatgatcacccgaccagtcactgaaagcgagatgcaaatgatgatgaaacggcaaatcatcagccaacaacataaacagcaactcatgccccagacacagatttttgctcctgccaatctgcaagttcaacaggcaggaacatctggtcaacaaattgccacacttgtaaaaacttcttcgggaacggtagcagctacgggaatgacattgtcccaagtgaaaccgggtcaactgaaaaccataagcaatcaaagccaggttcgacagcttcaactgcagcagcaaattattgctgcccagcgtaagagcggaaaaatgacccaaatcactcaagttgcgggcaaagccggtcaaccaacgcaactgttcgtacaaggcccgaaaaatcttcctgccggaactgtaactgtgcagcagatacagcaagtcatccgccatgcacagccggcttccattgcatcgggtggacaaatcgtcctggggaaaactagtgtcggcagagtcattcccgtgtccgtatcgcaacaggccaatcaaagacaaacaattcaggtatgatattgataagttacacgcccgtgcataagttttgggtcacccccttaaaccgtaacaagttttgaccatattccatattgtgattacacgtctaattgaaaatctctatggctcatccaaaaggcaattataggtatttttttttgctgttttcttctttcttcaaagtttcaaaacaataagacatttgaatcatattcttacattatttgtagagcacttgcaaaacttctgcggaaaaaaatcaatcaaacagtcatcatcgtcatcaaaaatcaccatgcaaaagttcagggtcaatgaaatctgttccacttagaattgggccgtatcttttagaaattactgtggcgcctctatttgtcatagcgaaaagcttatcagcagcgttttgaaccacagggctttttttgttttattaacgtgaattttaacacgattgctacacacaaaataatccacatatcactgttacgtgaaaacatacgtgttttttttcatcgcaattttcacgtagcaccagttttcgctcatgttccagtagcccgctaacactgaaaaaagataagtttatacaaagtaagtttgaaaactttagccgctatacaattctaatcgacaaatagcatcatactgtggacatatttttgtgtatttactcaacttaccttactttttgaattcgtgagcgagctacataagcgggtactggtacgttgacggtacttgaatcttaggtagctctgaaagaacgcatgaactaatgaacttcatccattaataaaagttttacgtaacagctatatgagtttcccgtagcttttacgaagtgtttcaatagattccagatgcttttccgttcttatcggaataaattcataggtttattaaaaaaataaatataacgatatttactgtactcaatataaacaggtgcgttttgaataaaatattctgcaaaatatccagtggaagtttatccagaatagcagttcgtagccaaatcaaaatattggctcatgttcatgttctcaaaatcacttgttaatatttttttaaagatttctactatatcattcagtgtccaattacaataaattgaacattatatctgtaaaatgacacacaagaaaaaaatctgtagtaaaaattactattttagctgaccatgcccattcttgaaactaccatggaattccagaccaatttactatgtttacggtacatcccaccacattactggtacatttgacagaaataatttagaacaatctgatttcgactacagacatggtaaaatcaagcgtatttcgtgtttgttgaaaatttccggtgcgagcgccaaaatagtagtttttactgcacattttgcgtgcacaaatgctataactaaccgattgacaaattcacatgttcaacgcttatttaccttgaaaacaatttgaaaaatgttcttgaaaaaaaactagcgcccatcacctttgcatccaagcctatcactgaatgaacgattacgcagatgtcaaaatgaatttgagtgcttacgggagattcacgtaagagcgataggtaaccgcagtaacaatcaccggatctccacttggtgattatgtatgatcaggtcatcattaccataggtaaagtgaggataaaatgaacttggaatgatctacgtgatttttttccggtagcaatgacgtttggattattttgagtgtatgaacgaatagtttaagtgctatgaactaatacatatagattatgtttcggcatatttactttttgtcactttcatccacattttcttcaattccagctcgtttttaaacaccttggacgattttcgaactttcgccttcattatagtccaaaatctttccactggacgtatttctggtgaatctgggagttggcggtttttggtacaaaaacaacgttattgtctctgtaccaattcaacgtcgatcgcgcgtaatggtatgatgccagatccggccaaaataatgtctcgcctctgtgagcccgcaggaagggcaacagacgcttctgtcggcactcggtgcggtaaatttcgctgttgatggtacccgtatactacggtacggtttacacagtttaccgcattagcatatggccggccagagcaagtattttttggcgaatttatccatttttttcttccttatgtcttccggaacatcaaatcttgacttagcaacgtagaactccagccctggtatcggctttgcgtctgccttgatttggtttcgtcatccataaccacacattttggtttcgttaaccactctcgatacagcttccttgcgcgggatttggccgccgtgtttagttgatcacgccctttcggaccttctatacacgaagctcaactcgtttcatggtttgctgaacgaaccaggcggaacacttggccttcagagccgtgtcgcgaatagaaaggttcggattacgtttgaaataatccaacaccttccgggccttcacaaggtcagctgtcttcgattttcttccacttccagctcggtcgtctaagactccttaaaagattttaccacccgggagacagttgtatggcagtgctgaaaaagttcgcatcacgatgcagctcacgagtgtataccaacgcataacaaacatcacagactcgggaactggctaggtgtgagtaagtccgcacccgtctgctcgggaaaacatgtcaaaagaagtagcaacaagctcaggagtgtttactcgcgagtaaccgagcaaggtgtgatttattatggttttgacagacaaattaattgtattaccatcatatcgacagtaaactacttgtttgtagtcaaaagcccttgaaaaccataaatctcggaggggaagcagcttttttcccaaaaacacaatatgactttgaacagctccgaacacgttcgcgaataacttttagcttcagttactcgggagccgacaaatgcgagtaaaccagcgctctgacgttcgggagcgtttggatttgtttttgttccagttcagaagaagtgttcgctactttccatcactgttgtatggataattcccagttgtcttccgatccatctcatgctcgcagtcggattttccatgacgttgcgcataattctccgtcgattttcttcttgtttcgatgccatctcaataatcactgaaccgattgttatgaaattttgcacatgtaaacaatacactccaatctagttatacccagattttcatcaatttttacccacggacaaaaaaagttacacacggataaaaatggtgcattttttgtaatacaaaccttactagtacatcatttactttaaaaaaagccataaactattgaaatgaatcaaaagctatagataagttgttaacaataattgtttacatgcggaaccccaagcttttgcacgatgacttgaattactattctatgtattttgattaatgttttattattatttatgaacctcttagcacagacaaacagatgtaacacttagaacaaatctcgatcaaaatcatagtcacggagacatatacgcccaatgctaaaatcggtgtgtttggccgacaggccaacagatggcggtagtgtgtaaacgtcaaacacgaacaaaaacgacgcgagcgctgcaggtggcgaataagccacctacaatatttttgaattgaccgttaaaaaggtggtcgatggacaattatttatttatttatttatttatatttattaatttgccatgtaaggttacacctttttcaattattgcattccgaattcatttagtgacgagtagtgagagtgtgacgtctgtttgtctgtgctcttagtagctgatattttttctcgacgcttttttgtcgacggatatttgttttatgattcctgttaacaattttcacgtcttgacttgatagtacgcatctaaaccactcaaaatcattcgattttcccagtataatatggattcgataaactgttttctatagggtttcgttctgcttcgtcgtaagagctactaatcgtcgtatcaaacttaaaatgttccactacggcggatattgtaacggtctttttttatcgtattcatgtgtttatgtggagatgaaggcaaatccaaatataaagtcaacatgaatcaacaaaactcaacaaattagagatatgccatgcgctactcattgggtgaacgagctctgttaccttttctcttctcgcccggctaaagcacactaatagtcattgagatactcgggcagccaataagtattttatgaaggaataacatttgatatcgagtgtattgtgcccattttgattacaaacattcttatcatctaggcctaccttatgcttataccctaagcttactagggtcaggcggggcaagatgagcaccctaaggataagcgcgatttaagcctacttaaacgtaattattctggtaaaattagtaaccatccttatcttttacattattactttgacctccaaccattaaaagttttaaaaagtgataaatagttttccaaataacactttaaaaaatagcttttttatcatcggtcaaaaaaactgcggggcaagatgggcacccccataaaaagatgcaatttactaaagaaaactattattattcaatgcttgcaatatcccaagatattatctttaatatctgataatatttatcttcaactagctaagtttttaaaacttttatcagaaaataaataactttccataaattgctaagattttacttaaaaaacgattaaatttgttgtttgtttgtatattttttagaaaaattgttttgtgcaaagaagataccgtaagtcaagctcacagctaaatgtggttctataatttcacacttttacttaattttgaacatggtgctcatcttgccccaagggtgtaaatttattaatataatcaaaacaattgaaatattttttaaatttgataaaaagttttgctcctgattatctacagaagattattctataactatacggccaaaaacgtatgaattaatttgcttacgcaacgaaaatatcacttttaaatgaacaaatcttatatgaaaaggttaatttttggacttctatgtattttggacaatatttacgttgtgctgttgattttttagctgaaatttatggccatcatatcaatttaatgatattcatcaaaaccccaaataatgtattgaaaaaaaatcggtaggaacgacacaaactaggggtgcccatcttgccccgggtgctcatcttgccccacattcccctactcctgccgacgatgacactgccgtttgacacactgatgcgatgaggaggggcccctatgctgcttcatgttcaccgttgacgtgacgatgttcgattgctcgctttcgagcgcttgagtattcggacaagctggctacactgccgtttcagctacacactttccgcaaaatgcaccgtccgcagacgatcaatctaaatgctgcctcacaactctcattcaccttcaggccaaacgctggaacatgaaatcttcgtggccgcttcttaattcacattccgcaattcaggtatcgcgacggggtaattcgagagcaaacgcacttgctgatgtttactgattaggtggcacacatgcacaggcactcttgagcgccgagaagtgcaacacaggcgacttgaactgtgtatgtcgctgttaggtcacgcacgcaaactactgcctcaccgttgatgtgtccaccggatcgtggacgagtgcttcgtctcaactgagctcttgtttacgaattcactcttgttgagtgtacgcacacacacgaccgtgatcgatgacgattcgatcggcaatgattcttcaacggatcactcctcgcacacggtttgcatgcggactgtcacactaacactatcgcgtctcttcttttgcactaacacggtcactgagcagggaggtactagaataacgaacggattcggttcggatcgtatggcttgccacacactatgaagtccggcgagatggcgatgccggcatgtgctgattgcgatggcacgacggggacgcgtgcgccgctgagaagcacgctataaaaggctctggaaaaatctctatgagtgggccattcatgaggtcgaaatgattataattttacctctgtttgagagccttctttggttatcatgcttcgcgcctagcttcgatctggtgatatcctcctatggaattttgtgtgctcgtgctaggcaaaatggtggttcaatcgacacgcgataggtggtacttttgtagctgcttctttcctcctccgaatgcctgtacgctggatctttcgattcgaagggatgtcttaatgatttgttccgaccacgctggattagcaggtttgcagatggcggtttcgcggatgcgatctggagggactcgaagcactacgaaaagtgatcgatgttcgtagcgatttgctttgttaggccaattgccgctcttgctgttccagtaacgagagagtgtgagggtgatgactataatatcatctttcgttcagcccgatgtttcgctctaatgtggctgaagcgttcgttttatgctaggctgcagtgtgtccagaagtaatcattattccttcttagcattgtggcgaacaatatttattcaactcagctctacagtgtaacaatattccaacttacctgcaacatagattcatttaaaaatgtaattttgtgaaagcttttatgattcgtccacctgtacaccaaaaatgcaatgaaaatactgtatttcgataaataacttcagttcaattatccactttacactttttcaccgaaatcgcatggacgaacacgatttgagagaaatgcttacgatcgacatcagtcacaccactttccaacacaagtttcttctcgcccccctgtgtgacttacatcgccgggcacttattttcattatggaaaaccttcgtacttcttcactgatggatttcactccaatcacacgccgtaaaacttcaataaatctcaaaattttacgaaatttcctcaaccgccgcgaataattgagaatgtaaacaaagttcaatccgtcgtactgagaaaaaaaaagtttgtgcgcatcaatgtgtgcgcgacgctcgacgtaaaaatacggttcctttgattgcacagtgggacggattggggttttaggaggaaagatggaactcacgccttcaattgtaattttacgtaaaaatgatgttctacaaagttgttcctattttaaaaacattttttttggtcggagccaaaattagggtggtcctttgtaaaaaaagataatcataaaaacttttttattttatagaatattggtacagtttgttctacaaagttgaagatcagaaaattttaaactgatttgaccaaaaaagtttttttctagctcaaaaattgaccgttttagagcatttttcgctattgatgtagggtggccctttaaaaataggtttttgtgttttatttttattatttcaagttttgtcagaaagttgccttcccatcacttttaaagctaattggaacgcaaacatacaagataaagctaattgaaacgaatagatacaagaatcttttcgtcatgaaaatttaatatactttcatagacataatttatcatcgatactaatacacatgatatacgaaagcaaaatgacaaatatgacaaagaaagctctcagttaataactgtggaagtgctcttcaatacagtaacctgagaatcataatctgttccagttagaatgtaatgccaagaaaatgaatattagaacattttttctgatgaagagttatagactatttttataaaaaaataacattttatgggtttatagagtaggggaaataaaaaaaaatcgttgatattattaaagcgtttttcagcttaaaatatgaataaaaattgtattattcttcggctgactggatcataagtacataactgttaaaacagttttttaacatcttccaaaacagctctacgtatcaaataatgcatatggttattttccttaatctggactgttaagtcagcatcgtaatcataaatcatactataataatcaaccgtttcaggtacgctttatctcctacgatgcacaaattacttttaaacggatttccggtaattaaaagttcgttagcgggatttggggcaagtgtgccaccttaagcaaactttgtctaaagctttaaaaacccatcaattcagccttatgatgttagtttcacatcttttcataagtactgtgccattcaaaaagaaaataatttaaaaaagtattagttttggagctcctcaaatatcatccaaaataacctgatttccaacactatggggcaagtgtgccacccttatggggcaagacggccaccgaatgaacatgcatataattctacttgtaatgaaattttctttattttctgttaatattgctaacaaaacagagcctaattgataattttaaaaatatttttaagtttaccgtcatgaggggatgctttataacaaggttcatcactctctactagtcaattcgaataacataaatcgttatttttgtctccattcaatacgatatatgaaatactctttcattacgggggatctgtattatatttcactagatctgcactaaataacggtaaaatattgataaaaataagtaaaatagttcttaaaacgcctaaaaccatgcaattaactaatatttggagaaaaaatcactgtgggagcaaaaatgttcgcttttccccttctacacttcagaaaccactactggtgcctcattttggttcattattatgattttgttgatgatgtttacatttttatgaaattcactccaaccatttttgtttaccaaataggtggcacacttgccccaaaaagtatagatttcaacaaaaatagatttcgcatgtagaactaaatatttttttcgtttaaatgcctcaattacttacacatttgtatagcttcacgatgtacaatacgtttgaaaaattcgttattaatttacctctcaccatgctatttagaaacaacgaaatcttataaaaaatcactgaaatttgatgattttcacaaaagttgatgtaaatacgtgaaaaatagagcaaatttcgtaatattttaaccattgtataatgaactataagggagcatattgttaagctcaaataaaaaatatagtttgaagtttttattaaaatcaggggtggcacacttgccccaaattccgctacttccaatcagaatgtttcccgatgaggctggtgaatcccataacaaaagtgtttagatgatgtttagaagactattttcttatatttatttatcctttgaatatattcacaagtacttttatatgaatatgaaataaaatactttgttattcatatttaaagccgaaaggaaattattatcatgcaaaaaaaaaaactttttgtttgtctcaaatacttatacaagtggaaaaatgtttgtttttcatgaaaaatgtttataactcttcatcggaaaaattgtgcaggccccaaaatatgcgtttcaatcagctctacaggtgatgggaaggcaactttgctgaaaaactctaaataaaaaataaacactaaaacctgtttttgaagagccaccctacatcaatagcgaaaaatgctctaaaacggtcagtttttgagctagaaaaaaacttttttggtcaaattagcttaaaattttctgatcttcaactttgtagaacaaactgtaccaatattccttaaaataaaaaagtttttatggttatctttttttacaaagggccaccctaattttcgttccgaccaaaaaaaatgtttttataataggaacaactttgtagaacattatttttgcgtaaaatcacaattgaaggcgtgagttccatctttcctcctaaaaccccaatccgtcccactgtggattgtgttgttttcgctgtactgtgagcaaatgccagaattatacggtcaaaagtaattgtgttcatatgtttgggctgaattttgataagaaacaattaattttaaaggaaattagtatattccatcatgctgaaggaatggagggagatgcccgtagatctatattttctagtaaaacattttattatagcgttgatgtattgtgttttagccactcaatacatcaaagtgagccgtaagttgtgagacgaatctggaaacttattgcgactgagttgaaaacgatacgacggattgagaatacggtaagatgcattatctttgcattatttccaatgctaaagccgttttgagaaagaattgtttggcatcggtttgtatcagcatcattcactgcaatactgggaaaattgcagttctcgctgatcaatgcttaatacgatggatactagcacatcaccctactctaattatgaaccccgcctgtgttcatagatcgttgcacgcttgacctaacctcgaaactctatataaaaaaaaatgtcaacaattccagcagtgaatgtcaactccatataaaaaaaatctaaacaattccagcagtgagtgtcaaagagcaggacagtcaattgagcgtgatgaaagagggacagagaaggataattttttgtggcgtcaccatgcactcttctataataggaatgtttttgaatttgacgtttcctattatgagccctccatttgattcctatgttataatccacctagctgtcgcgttggctattattgacccacctggaattgctaattatgaaccctctcgtgggttttcgtttacaaaactgcttaaataacagtattttggcactccagacaaaatatttttcctgaaactgttgctaggaatacaaataaagttcccggtggatgttcccaaaagttcaagtgttatttttatgcttttctgtagggcatccataatacgccaagagcaatgagaatatataacgaggtgtggaaaagacagttagtatgggtgaaatccgtgcacggtgcaaaatgattcacaactacaagcgagtgagctcccataagaagccgtgtaaattagtgacgtagtttttgtgtttacgttttttctccctattaatccatagccattgcttcttcttccacaccttggtatatattctcattgcgccaagggtccaaaaccggcaggcagagtctatatacagagagttgcccgaagagacttctttgaatggttgttcttcttcgtcttcggaaatagaccctatctgttttgctggtctgctcgataggtagacggtttgtcagttcggtaggtagaattggtttcactcttcgtgcaactaaaagtcctcctaatgcggtaacacaaaactatcaaagaacacatagcaacgattatataaatcaccgcggacctagcaagaaaaatctatcattggcaccgcatttcttgtgaaaaatcttaccgcatttggtgttcccgcagttgatatttgcatttcaaacgcacacagcaatatcgtggtcgggtacgatgatacattatgcccagggaagtcaaggaaatttccattacgaaaagatcctggaccgaccggtaattgaacccagacactttcagcttggctttgcttagtagccgcggactctaaccacttggctaaggaaggcctcatgggctaccttgttttccgtattgtccgccaaaatgttgctagtgctattcaaagaatataagagtgtctgggtctattggcaaaaccatttttcatcaagaactggcatcttttgaaaaagggtctatttctgtttatgcgttatggtcatggtcgttatgttaaatgaccatatgtcaaacgagcctttgccaaatgatccgcttctatgttctcagtataatttttgaaaaatgtctcactttcgagtagaaatttaataaacaaaaaaaatgatcaaactggttacctacgaaacataattaccgtcaagctaccattcaccgtgcatttaagaaaaaaatttacctcaaaaaactatatcagagtggccaccgaaccgggaaaaacgggaaaagcgggaaaaagacgggaatttgaatccatcgggaaaacccgggaatttgagatgatcaccgggaaaaccatattgaacgaacatctacaagctctaaatttactaactaccaaaaacaagttgtaaaaagtaccataaagtaccattgccattgagcatctgtaatcttgggaaaataacatttaaacagaagtgatttgttttttttgtaggaatagtttacttcgctacacttatcttagaaatgttatgttatgttgttaatgttatgaagaacaaaatcgaaagattataaattaaaatactttaaacagggtaataggatgcacaaaaggggcatacctgcatttataaatgaaaatggaatggttttcgtatgtcacaagttggcttgataacgggatgaccgatttaaacaattctttcacttttgttttcttcaagggggcatatagtatcttcgtacctgccacacgatatacgcatgcaaaaatggtcattggcatagtaagctctcagttaataactgtggaagtgctcataagaacactaagccgagaagcaggctctgtcccagtggggacgtaacgccagaaagaagaagattaaaaccgggaaaattttgaaaattataccgggaaaaccgggaatttcaaaatggatatttggtggccaccctgctatataacttttccaaataatttggagcgtactacaatacctctaagtagcgtgcaattatataataattcagggaaaaatctaaaactagggatgcataacaaaaaaatactcaaaaattatgtttgaaaatgtcatgttaaggtcgcctcgtaccgttctatgtcaccatttaccgtgcacacttcaccgtgcgtatcgttttcgtcatgattttattttgtatcttgcagaaacgttgttgatggtgcaactttgttgctagtagtatgcacactcatttttaaagtactcaaatcttcttttacaataaaaaccataaaaagttcaaaaataggctacattatgatttttaaattaaaatcgttgtaggaggattgactgtattgtccaaaccattccatactcactcagaaactaaatatgaagtagtttaatgacgacataacaataaatctaatattaccgaataatttcatgtcttttatactaatgcacggtaatagcacgtaataggaaccatatatatatattgaaaacgatccattcaccgtgcatttgggtttcgactgaaacacaataaaaattataatttgcataaaatctcattgctcatacgatgaaatacatcttactcatagtatccacagtgaaaacctgttgaaattttgaaaaatttcatactctatcgttaaaatgaaaaatgtgaatttttggcgtttctactaagagtgttgaaaaatttcattatcaaacagaattcacatgattttgactagagatgtaccgaatagcactattacagtcaatctggccacacggtcggatattgcacgcgcctcatttcgttcacttttgcaacgtaaatttcgtcgtgttttcgatagtgtaaagtcccagatacattcgcgttggatttcttagtcacttgaatgtccccggaaagtccgggatacaaataagatgtgactacaacaagtcacatagaatcgcagctaattctaatgaccacgaagaatctacccctgagtgtccgaagcgtcaaaaaatgagtcaccctgaactcacgacttccactcagtcaacccactgtaatatgagtgccgtctgtcacaacaatatctacaacagactgcccaatgatgtcggggacacttatgacaacacaccccaaaaccagctattaccgccggggccctccgaacccaaaaagttcagatgcccaccaataacggtcactgggaaaagtacaaaggaacttcgccaattcttctcaacggagaatgtgcctcaagacaagtaccaaatgaaggtgatcaaaaacggtgttcagctcattcttggaagtaaacaatacttccaccaaacgatttctagtctgaaacaaaacggaatgcagttctacagttatgtcccagcggaagaaatacctgtgaagatcatactttcgggtttatcgatgtatgacctcgaagaactcaaagaagaactgaacagtaataacatttctccaaaagaagtgaaagtgttctctgtgaagaagaacggtgtggaagacaatgttctgtacatgctacatttcgagaagggtacagtgaaattgcaagaactaagaaaagttagatcgctctttaacgtcatcgttagatggcgaccctatgtgaagaataaaagtgacgtcgtacaatgccatcgttgtcaacgattcggtcacggaaagaccaattgcaacatgaaccccttgtgtgttaaatgtggagagaggcacgcaatcacacagcaaattttcgaggttgtcctgccaggaagacatacctgaagtcaattgaagatcgtgtcactgtgaagagaaaatcccagaatccgtattcttctccgcagggacaatccctgctgtctcctagcgtcgaacatcatcgtcaaccacaataacaacggccgtccgcgatactccgatgtggttcgtaatagcgaagccggtggtagtggaatggaccctgatctattctctatatcggaatttctgagcttggcccgcgatatgtttcaccgtctgcaagggtgcagaaacaaaatggaacaattctcagctctatctgagttgatgctaaaatacgtctacaatgcctaatcacgctaaactaaaaatgcttaactggaacggaaggtctattctgcgaaaatatctcgaatacttcgatttccttcaccggcatggtattgacgtggctgctgtttcggagacgtggttgaactcgcacaactcttttatccatccgaacttctgctgtttgcgtgcggacagacagcgtgaaaatgcagagaggggaggcggagttatgttgacggttagaaagggactgtcgttcaagcaaattgaactttgtactaaagtcatcgaagcaatcggaatcctcgtggtctgtaatggaacattgatgaagatcgtcgcagcatactttccgggtgcacggcacagaggagagtggcagcattttcgtaacgaccttaggatgctgtcagctggtgatattcccacatttgtcattggcgattttaacgctcgcagtcgtcaatggaactgcagccgaggtaacaaggccggtactcaactgctacaaatgtcagtatcagagaattttttcatccacgctccagacgcacctacctttcatcccacgggcagagggcagtcgtctacccttgatttggttttatccaataacatagtggatatgtcaagacccatcgttatcaacgaattatcttccgaccacctaccagtggtattcactgtcgactccacaccttcgaccgacgtttccgacaatactaaatattgctatgttcgtgccaactggtccagattccagagtattgtcaacgatagcatcgatcttacagcgccaattgttctggagatcaacgacatcacatctgtagatggcgcagtcgagttcttcagcgatactattcttcatgcggaatgtctttccgttcccaagctacctattcggccatacgatgttccagaaatatcgcagcataccagaaacttaattcgccttcgcaatcggcgccggcggcagtggatacggtcgaaagatccgttctacaaggtaatcgtggatgcgctcaacaaacgaattcgtgaagaatgtgcccagtcccgctttcataagtttggggaagtcatcagcaatgtgaacttcgttgaagttaaaatgtggaaatctccagagcactacgtaaaaacaccaaatacactcctccactgcgacatggtgatctcctagttgcttcatcccaaggaaaagcagaactactagctgaaagctttgctgcagcacacaacaatactgcagttagtgataatgccacggtaacagcagtagcggaatcaatccgcgagatcaacgaatcacccaactagtttggtgcagtctgtctggtaagaccgaaagaagttcaactactaatcaataatctcaagaacaagaaggctcctggtcgtgataaactatgcaaccatctactgaagaagataccgcgcaaagctgttatcctgttagctaggatctttacggtctgcttacagctgtgctatttcccaaccgtttggaaacatgctgtggtcgttcctgttccaaaagctaggaaggatattactaatgctggcaactacaggcctatcagtctgcttcctgctctaagtaaactgttagaacgcgtaatcctctctagaatggaacggcatatagaggcaacccatgtggttccagatgaacaatttggatttaagcgtggacattcaacgaaccatcagctcgtgcggttggtgagtcaagttaaatccgggttttccaacaaacaatcgtcaggaatgattctattggatattgagaaagcgtacgattctgtgtggcaggatgccgttctccacaaaatgttagctgctggttttccaatgtacctaataaaaatcgtccaatcgttcatcaaaaatcgctttttcgaagttaatgtcaatggtgcggcgtcggatcgtagaaacattccccacggagttccgcagggctctgttctcagcccaatcctatacaacatcttcaccgctgatgttgttatggtcgatggagtactctatttcgtcttcgccgatgacactgcattcgtcgcaactgattcagatcctacaatagtaatcacaaagttgcaagccgcacaaaacgccattgaaggataccaacgcaaatggaaaatgaagatcaacccaatcaaaacccaagcaattttcttctctaaccgtcgcagtccgagacacttaccgcaacgtaaaattattgcgggggggctcgaagtagaatggtcaacagaagtaaaatatctggggttgatcctacatcagaagctgaaatttggtattcatacccagaagtcgctccaaaagtgcgacaaacttgttaaatgtttatactcgctaatctgtcgtcgctctcgcctgaatacatccaacaaactgctgctctacaaagccatcatccgtccaacgattacctacggttttccagcttggtgcaattgtgcgagaacccatcgcaggaaactacaaaccaaacaaaatcgactgctgaaaatgatactagaactggacccatactaccacacagaagccttgcataggctagccggaatcaacacaatcgaggactggatcaacggcctgctacccaaattctggaatagctgcaatctttccgcaaatccattgttacaaactattcggcgccctctgtgatattagtacattaagaaaaattttcctttaactatcccattttctttaagcaattaccctgggcttgggattatattttccagggagcgatgaattttgataattgatcgcttttgttagtagttttgattagatgttgggtgaatttcaaagcaatggcaacctttttattacaaaatttagattttatcttctgacctaaaaattctggttaaactactgtactatgcagttgggctgcactaggctatcactcatcaaaattactttcacttcgggaaaatataatttcaaactggcgagaagattacgaactgagggtgggttaggagcacaatcagacccttgaatgtgcaatgtggggtagtaattgggaatgccattgacggtttgtaatcttctacgaggttttcgaaaaccaacagggcgcgtgcaccgggttgcggataggagcaaagggagatcaataacatctacctaaaataatagggcaacaagccgttccatgattaggtaatgtttagcgatcttctatggtgttctagtactataaaattcttcactcactgggaattttggccttgataatatcaatagtgataaaaacataaaataatacctaatacataataagtacaatgtagcttcaatgtagtaataaatgaaataaaatcaattttctatacttgacaaggttttgaagacaatcaatgagtgaaagaactacctattagaaaagccacatcagctaaggctatacatatacaaatgttggtcatagggtcatggcgagcattcggtatgtatgtctatgactgatttttttctaataggggcactagaagaccacgcggacaatttcgaaacaaattatttttatgcatcggtcttacgaaaggctcagctatgctgcaaagtcattttaaaagctattcattactactgtttaattgtttataattctaacaaaactacataattaactcattactaatcactgttcctatattctctttttctctccttcttatctgttgcatgattatgatcatcactaatataatgcatgagcatgcacaataagaataatttcaggattgaaagcagtacatggatacctggatagaatagcttcgaaaagggtgctcaaaatataatatttctgatcagggaagtattattataaagggtatgtaaaatttttccattattaacacttagatcacacaaacaaatgaactaataatatcaaatatttttatataaatcagcatcgtcaatcagtgcaaaaacagataaagtttgtaaagttatcaccacagacaaacagacgtcacactctcatcattgtccatcgaccaccttttaaacggtcgattcaaaaatatggtaggtggccaatccgccacccgcagcgctcgcatcgtttttgttcgcgtttgacgtttgcacactaccgccatctgttggcccgtcggccaaatacaataattttagcattgggcgcacatgtcctcgtgactatgattttgatcgagatttgatctaagtgttacgtctgtttgtctgtgttatcaccatcgattgaattgcgctctgtatagtaatgttcaatctgtatcaaaatctcctaaagcgtcgcattgtgccatcagcagcccttagcatcactctcatatcacagacaaacagacgtcacactctcatcattgtccatcgaccaccttttaaacggtcgattcaaaaatatggtaggtggccaatccgccacccgcagcgctcgcatcgtttttgttcgcgtttgacgtttgcacactaccgccatctgttggcccgtcggccaaatacaataattttagcattgggcgcacatgtcctcgtgactatgattttgatcgagatttgttctaagtgttacgtctgtttgtctgtgctcatattgttatttttttttttattctcaatttacttatattctaattggagctcatttcgccattgggcatcacttgagcgaggatcaattggaatgttgtgctagagcacaacgcctaaattcacactattttattacctaatctatttttagatctgatgctacgctgtctctttgcgctctctacttttcgcaggtagaacgaagagcacgcagggatgctttatcagtccaagagaggtccatttgttcatagccgttggtcgattgccgtgttaatccgggtacagttgagcattcgctcagagaagggtcagatgtcagtccgctttcagacagccgtgattgttggacggatgttcttgagtggactgacgaagttttttttttgttgaaagggctgggaatcaaacccatgaccatccgcttataaagcgaacgtgtagccaactacgccacattgcccccctattgttattattttgttgtttataaaatttctagaaagcgatcagcatattctttcttacttgtacaatgaccgatctatttggaattttaataagtcaaatctaacttcaaaactcaaattaaattgctttcagcacatttacattttgcagcattaatcgcattactgtgtcaagtcttctccattccctataccctaccccaacccttcttatcctttccgatggtgttcaagtggtccgcatagactattacggccattacctatcccttcccccggctttggactgacttgcgctctcattgccccaccaaacgctgcaaaatgaaaatgaaactatcccattttctttaagcaattacaaaggttttttttgttatagttttcctttaaagttgaatccatatttatagaccctaaactaaattaactatacatgaactactttactgttgaaaggatctccaaatctcagtgtatgaataatgtatgaaactatctaaagaaacaatcaataaaatgaaatgaaaaaaaaaatgaaatgaatagcactattcggctttcggccgaatactgaataggggtagtcggggcggtttggccaatggggtggaatgagcaccccttgaaaattgcatacattctgtaaatttcatctgaaataacatgcaaccccaaagctgattaggaaataaagcaataggcatgttataagtcagtgttcgaaactcaaataaaaataaataaataatgttcgaaaaaactgcccatattgccccgaatggctcttttgaatttcatcatttcagaataatgatgtttgactgttagaatgttccttaaaaattatatcttcttgcacgaagtgtatataaatactaataattttcaagggtagtaacaaaataattgaatttttagattatatgagattattttgcaatcaaaaatggggtgctcatatcaccccatcagtaaaaaatcgactcaaaaaatgacaaattttgaaaaatcaatcattcatccgtgaactttataagacaaaggaaatcatgcggatctagtgtgttcatctaaaaattgttggaaatcatgcaaacattcgaaaaattcataatattttcagcacttttatcaacttttccttaaggtggccaaactgccctactttcccctagttgagaaattattattcggccaaacgaatattcggccgaacattcggccgaataatgactcaatattcggccgaataaaaccgttaatttcggtcgaataacacctagtttttaaacagggatagcttccacggtgaagaattgttcggaatgatcgttttaagcttttgaaaccgtgtgaagaaaaaacaaaagtcaaaagctctgaggattaatatttctaaagtaagggatttgcatctttttgattgcagttttgatccatttaactttttaaggaactaggttaatacgccgctttatttctcatctcacttctggaagtgcttcatattaattagagcaaatacatcgcatagggtcggtgttcccttagtagacagtcccctatattcgcactagtagctttttacgaccgtttttctataaatcgttgcaaaatattttttgacatgaatgtcaggagttatttatctaagtaccattgattcacagatcaattttgttcaagaaatgattttttgcttaaaattctagctcccttgcacctttagtacacctactgttcctatagtagagaaactttgttttttttttgaatagacatacgactttgatttttttttgttttgcctgcgccgtaaagctattggaacaggaattagaaatagcgctactatagtcacatgtgttcctataggcacaagcgatgcaaaagtttgaattttcgttgtttccatattttttacaaaaccaaggtgaaaagcactttcagtttacgtaaaaataatgccacaatacaatccatgcaatatgagtgaaatattgaatggcttgtatattgagcagcatcgcaatgccgtagaacggaaaaattctcacatttttaaacatttagtatcaaactccatccatggaatccaccaaagggaaaatttgatgtatttaggggtaccgggggcagtatggacacccggggcagaatggacaccccatgtatctttacataagcgaatacttttacactttaaacacagagaaacagacgtaacacttagaacaaatcgcgatcaaaatcatagtcgcgaaaacaagtacgcccaatgctaaaaacactgtagttggccgatggaccaacaggtggcggtaatgtgtgaacgtcaaacacgaacaaaaacgacgcgagcgctgcggatggtcgattgaccacctacaagatattcgaatcaatcgttaaaaagttggtcgatgaacagcgatgagagtgtgacgtctgtttgtctgtgctttaaatgcaaacaatatttcagttgcctgtcggaggagtaaattatcctctaatatttcagaaaaaatgttcaaaacattgattttaaatagaaaaattgagcatgttcttatttggttcgaaaattataacattcacacctcaccagccctcactccggaagcactgttgatgataaagacgctttttacgcgcagcttgaacgcgagtacgacagttgcccaagccacgacgtcaaaatcatcataggagatctaaacgctcaggttggccaggaggaggaattcagaccgacgattggaaagttcagcgcccaccggctgacgaacgaaaacggcctacgactaattgattttgccgcctccaagaatatggccattcgtagcacctacttccagcacagccttccgtaccgatacacctggagatcaccacagcagacagaatcgcaaatcgaccacgttctgattgatggtcggcacttctccgacattatcgacgtcaggacctatcgtggcgctaacatcgattctgaccactatctggtgatggtcaaactgcgcccaaaactctccgtcgttaacaacgtacggtaccgacggccgccctggtatgacctagagcggctcaagcaaccggatgtcgcagcggcatacgcgcagcaactcgaggctgcattaccggaagagggtgagctgaacgaagcccctcttgaggactgctggagaacagtaaaagcagccatcaacgatgcagctgagagcaacgtcgggtacgtgggacggagtcgacggaacgattggttcgacgaggagtgccaggaggttttgaaggagaagaatgcagcgcgggcggtcatgctgcagcaagggacccggcagaacgtggaacgctataaacagaaacggcaacagcagacccgcctctttcgggagaaaaaacgccgcctggaggagacggagtgcgaggagatggaacagctgtgccggtctcaggaaacgcgtaggttgtatcagaagctcaacgcatcccgcaacggcttcgtgccgcgagccgagatgtgcagggataagaatgggagcattctgacggacgagcgtgaggtgatcgaaaggtggaagcagcacttcgacgagcacctgaatggtgctgagagcacaggcaatgaaggacgggacaacggaggaaatgccttcgtcagtactgcggaagatggaaaccaaccagcccccactttgagggaggttaaggacgccattcaccagctcaagaacaataaagctgctggtaaggatggtatcggagctgaactcataaagatgggtccggaaaggctggccatttgtctgcaccggctgataggcacaatctgggaaacagaacagctaccggaggagtggaaggaaggggtaatctgccccatctacaagaaaggcgacaagttagactgtgagaactttcgagcgatcaccattctaaatgcggcctacaaagtattatcccagatcgtcttccgtcgtttgtcacccgtagtaaacgagttcgtgggaagttatcaagccggcttcgttgacggccgatcgacaacggaccagatctttactgtacggcaaatcctccaaaaatgtcgtgaataccaggtcccaacgcatcaccttttcatcgatttcaaggcggcatacgacagtatcgaccgcgtagagctatggaaaatcatggacgagaacagctttcccgggaagctcacgagactgataagagcggcgatggaaggcgggcaaaattgtgtgaaggtttcaggcgaacactccagttcgtttggatcccaccggggactacgacaaggtgatggactttcgtgcctgttgttcaatattgcgctagaaggtgttatgcggagagccgggcttaacagccgaggtacgatttttacgagatccagtcaatttgtttgcttcgcggatgatatggacatcgtcggccgaacatttgaaaaggtggcagacctgtacacccgcctgaaacgcgaggcagcaaaagttggactggtggtgaatgcggccaagacaaagtacatgctagctggtggggccgagcgcgacagggctcgcctaggtagcagtgttacgatagacggggatacgttcgaggtggtcgacgagttcgtctaccttggatccttgctgacggctgacaataacgttagccgtgaaatacggaggcgcatcatcagtggaagtcgggcctactatggcctccagaagaagctgcggtcaaaaaagattcacgcccgcaccaaatgtaccatgtacaaaacgctcataaggccggtagtcctctacgggcatgaaacgtggacgatgctcgaggaggacctgcaagcacttggagtcttcgaacgtcgggtgcttaggacgatcttcggcggtgtgcaggagaacggtgtgtggcggcgaaggatgaaccacgagctcgcccaactctacggcgaacccagtatccagaaggtggccaaagctggaaggatacgatgggcagggcatgttgcaagaatgccggacagcaaccctgcaaagatggtgttcgcttcggatccggttggtacaagaaggcgtggagcgcagcgagctaggtgggcggatcaagtgcgtatcgatttggcgagcgtggggcagaaccgaggatggagagatgcggccacgaaccgagtattgtggcgtgaaattgttgattcagtgttatctgtgtagatgttaactaaataaatgaatgacctcaccaaataaggtttcagaggcaaataactgcaagttgaccgataatgtagctcttgattgaatcttcaattatttatgctatattcaaaatatagtagattttttttgtactttaagacattgaaaaacttatataaaaatttcttatactgttggggcaatatggacaccgggtgacaaagtagagctgacacttcaaagagaaaaaaatataacttcaaatacaaaattatccaaaaatatttagcattcaatgcaatgattatgaagcggaaccacaaatcagttgaaaatcgtcaattcttgattaaaactaacctggaggcaatattaaaagcatctctacgaaaaatgtcgtaaattggttttaatcatgtttccagtggcacagtgacctgtcactatggtttcctgaatatgaacttcatttttcgaggttttgagaacgatcgcgggacaattttcctataaacattagggtgtccatactgccccatgggggtgtccactttgccccgctagcttgatggcgactaccaattataagctttttttaaacctatttttgaaaacaaaatatttttttcccaattatgcaaccatgtttaacaaatgcttaagaactctaaaaagcatactgcacataaaaaacagtataatattcatatcctcacagtcaaaataggcaaattccttagggtgtccatactgccccgtgtccccctatcacttgaataaattaatcgttttttttttaattttccttcgtatgaaacataatgttttgttacaatttattttattttgttattattcggtcactatttggcctattcggccgaataacagatttcattattcggcagaccgaatattcggcaaaatcaaaataatcgagatattcggcccgaatattcggtacatctctaattttgactacataaactaggtttttcaaatcgcgtcgtgacaacaactacttcatttcatcagttttatcttatcttgctcacaaaagagtaatttgagaaaattgtatgaatgttctgtagtaatttgtatatgtgcacggtgaatggaggccgcacggtgactggtgacttaacggtatcgcattgccttcgaatgtgctacagagagtttctattagtcgtgtaatcacagattggtatatatgaacaaaaaacttttgtgtttctcaagggctacactaagcttttgcacgaaagtgtatgaatcatttgattgtattctaatttcctttgaaaattccaggttgtcactgcgacgtcagctgcccaagccatagcggctggtaacattcgggcacatgttcccactcaaaacatcggcaccatcaaggtagcagccggtgccactccagctcaacagcaacaggccattctaacagcgttgcaaaatcaacaacgccaaaatgcaagtccggtgcgattgcaaacgtccagcggatcattggttgctgtaacggtacagcaacctcaagccgtggcatccgccactagtgcagcagaattgcaacaacaaactcaacaggttgttagcgcagctcagtcccagcagcaacagacccaaacagccacacaagtgctgcaaatacaagcacaaccgcagcagattatttccactgcaactgcagctggtgacggaacgaatgcaactgttgtgcaaacgcaacaagcaacacaacaagtgcaagtgcaacaaacgcaatcttcagtcacagcgcagcagcaggtgagtatgatcaagaaaaagcattctcctagtgggaaatagaggaaagtgaagtttgttcgatttctgtgtgattaaaattgcgtggttgttgtattgaggaacttttaaattgaagctattcgattggttaagtgcaatgtttgagagatacacaaaaattgaattattaaatgaaatttctaaattttcaacaatttagttcctcaacaccaggttgaactagcaaatatttctcaatggttttgtctgtgacaattgtgatgtgacattgtgtaattttttccgttatttctgcgataaatctaatatgttttcctgatttggtattttctttctagcctaagtaaaacgtctcatagtcaatgacggattacctactctaaccaacggttgcactttacttttttttaaatgctaaccttcactgaaggacttcggttgtaagtcatagctaatttatcatgtttcaatacaatctactaaaataaagaaaaatgaaatagtacgacaatagatttggcttcttacaaaaaaatacatttctcacacaataatcattctacattcaatccatgtcgtagcatgagacatcaacaaaaatcaccaaaaaatatgaaataatcataatcccacaacccatttcaaggacttgtgacatgaactagacgttcgtccatgcatcgtataaaaacattcagcattagactgaataaagtgatacagaactttcgaaatagatcactaatagactgttataattgcaagcaattattcactgcgaaaatatgaatcgtttaattaatattgtttctttttgtggaacttttatgtatggatgctagaataagataaacttaagtcagatgtaaacttcagaggtctcaacggtgagttctatgatcttttaaatgtttcattaagctatttaaacgaatctgaatcatattatttaaaagtattattaaatgctaatcattaccaatagaaattaaaattattcaatcgaaatgcatgtcatttttcttgtttcaacaatccgaaaatccacaattagggatggtacacaaattatgccacgctaaatttcgaatttttcgacgtttgtcacgttttatgtatgggtctttcgaaaattttataaggctgtcacgcttggctgacccctcctttaaacgtgacgtaatttgtgcatgaccccctatgcccatattggaatatctttcccatctgctaaaagtagacattaaaaaatggaagataatgtttttaatcacgcttcctgtacaaaacgattatatggttatttgcggcttcaatattctaaacaatacctcatggacacctcctattgtacacattttactgaaccaaccattaacccacacatgcttcctgacgtgatttattaatgctcccttgaaacattaggagatgtccaaaaatcgcgctaaatttttccattttcaacgcctttccaccttgcccacgtttttcatatggaaagtgggaaaatttggtatcaatcgttgtgtttccctgaacaccctccccttcctaaaatgtcacgtaatttacggatggccctttacatgtgattacataaagtat

SEQ ID NO: 175 - DNA, 15263 bp, Aedes aegypti
gattttgcactgagttgtttttttcgctgttgtcaaacgaaaactatctaatgataggtatatgacagttatcccaaatttgggttatcccacactccgaaacacggatagtcacagaatgactaaattttagtaatttataactattttctatctgcctctctttcatcctgcaggcaattttattcctatttgtcaattcgcctgggttgaatcatcgctaagctgcaacccatgcagtcgaaatgacagttagtgtaaaaattcacagcagaatgaaagagaggcagatagaaaattgtcattaatgcataaactttagtaattttgtgactttttctatttctgagtgcacggatgagccaaatttcgtcaaaagaagtcaaagttggcttggtttgtggctccgtgtacgatgaagtgcaatttcgttcagtgtaccatttaacaaattctgttctccaaactttggacgatctggcacaaacgtttgccgaacggcgtgcatgcacgtgtgcgtgaaggaaaatgtgcatcctggctgcacgtaaaatgcattatcggaacgtcaacttgagttgtcatcgtattttgctttgatcttttcgtcgcgaaaatcccgtctgacacgcacgaactttcgttcctgtccgaaatccgtgaatttcgacaggtaagtggctgaaattattcgtttcgtgtggtttattatatgaagaataagtaattgcaaagaatttgtttaaatttgcttgatttgctcaattagaacggtggtaaacagccgttttgtgggcgagtattttggaagtgaggttataacttggtgtccagctggctgaagtgaaattattttgcgttctcctttctcatcccctccgttcgtttcagaatgtcgcgaaaccgagcagccgaggaaacagacaagcagacgcgtattgccatcgtcagttccgacaagtgcaagccgaaacgatgccgccaggagtgcaagaagtcctgtccggtggtccggatgggcaaactgtgcatcgaagtcgcaatggattcgaaaattgcgtccctctcggaggaactttgcatcggatgtggtatttgtgtgaaggtgagttttctgttaatgttgaaatttgaaaagggacctaactacgaaatgtaaacaaattagatttttcattattcgtatcaatttctacgtaaattattcttacaccaggcgcctcccttagccaagtggtaagagtccgcggctacaaagcaaagccatgctgaaggtgtctgggttcgattcccggtcgttcaggatctcttcgtactggaaatttccttgacttccctgggcatagaatatcatcgtacctgccacacgaatacgaaaatggcaacattggcaaagacagctctcagttaataactgtggaagtgctcataagaacaataagctaaggcgcaggctctgtcccagtgagggcgtaatcccaacaagaacaaggagatcagtggttcccaaactttttgaagccacggacccctttcaagctgagtcgacccctgaaaatgaatgcttattttttcactatttcactatctgatgaattaaatgcagcttagaatagagtaaaatgtgtcaaaagttaaaatggggcaaaagtttatttttaagatttctttcaaacttttcaaataccatggtggttcggatgctattcaagtaagagactttcactcttgtccaaggatgctgtgtgttgtactatgtttttgcataatgggtacatgcatgccctgattcgctactcgccacaccgtaacgcacatgcgctagtgtccatgcacaaaaaatcgttaaaaggtgaagcgaaaaatatttgtatggcgaaaagcatctattattatttctcaaaattggtaactattttcgaaaaaatatttggtgctggttgtgcgtaatgatgatggctatcacgcttaccaaatagcaagggcaagagcaaagcaggtaatcgattgcttggaaaccatttttggcccatagtgatgcaaaagttcgagtcagcagggcagaagatccaaccctagcttattccgtatctattaacatttatgtagctgtttaaatgaacatttgcctacccttggggcaaaagttcgtttaagacaatcaattttagaactgtaataactaaaatgggtaaattttttgacataagtttgttcagcaaaattgttgcaaatacgctaatggtgcactgtgtggtatttatttattttcaactgttagcttttctggattattttattatagcactaaagtcgaaattttgccccaccttactctgaggataacatgaaaataactgcaattactatatattacaacgtacgacatattctttgtacggtccatttttcataactcgatattgaagggagcatcgagttagggagttataggcaagacggccatgaaacccaacttttactatggctctagttcgatttcgggatacagttcggactcgattatccggagtatcgatttcttttttcacgccggataatagaatcctccggataatcgaatcactaaaagaaaaaataaaatctgtggtaaaagaacttaaatattatctttctaggtcatgagaagaaaaaaatgtttttgacagcatacacaaaacatcctttttcataccaacgtccaaaactgcaaaaccattcatattgtatattgcaataacaagttatcttaaatttacgcaaaaaatggtcaatttacgaaaccattgtaggctcgttttcaatagtgatgaaagaaggaatttgtcgatataaattcatcctaagcactcgccctttgttagatatcccgggaaagttgtgcttccacttctcgtttctaaggagattacctctccatacttcatcatgtggtcagcaacggtaacgtgactcatagacggtgggaaggcgtagacacgtaccgtcactgcgtcacaatcgatgtagaccggaatccgaaatctcgtattaccgcaaagcattgtacgcttccaattatgctctgattggtagcgagcggcaatttcttgcgctttcatttcaatgagcacacagttgcgcgtttgatgcaaagacgtacgtttgacgcgagcagagattgggttacaactgagcaacttgttcaagtccactctattgtaaatttcatgaggtttagagttttcatctatttttgccaaaagaacaccacctctactttgcaaacgtactttttttttttttttttttttttttttttttttttttttatggtgtactcagctggagctgtatgacagcttcgttgtctgtgctggaccccgtagtgcaaatttttacctctacttttgccaatatttagacggaataggctatgttgcccgctttaacactattttggatgaatattgtgcagaagtagttttattaaattgtttttgcttcagtttccctcccgtagtcatgtttgtatagtcatcctttagttctgagcaatcggattcttgtttacgcatgaagaagcgacatgaaaatatatgttgttaattaatgcatttcttggaaataacatacagagctatgttgtagtagtctatgttgacaaattgtagcacagatgtcatctccaagcatcttttgacaatgatagacagaaaatgttaattatacagaatgcggtcgtatatcaaacgatagcgatagggagatccttttttcccgaatggaatgaaggttattgaagtgaaaaacatgaactgtacttccatctatacgcgaacaagaactatctgaagtgcctcgtcattgtacgtcatgtattctctagtattttagtcgtttatgctactagtctgaaacgtgatgtgttatactatatgaataaatttcaaaatatgaatcaagtgtttggttttaaatagtctttatcttccgaagatcgtattggaatgctaatcaatacaatacttttctaggagagatgactgtctatgttgccatcttgtagtaccgaatccaagttgtagataattaatatgaggagaagtatcaaatctaaatgtactgtaaatgtgtttggtgtggtcatcgatgtgctttatgttcgtcttattgttattgttctgaggtcttcttaaaatgagaattcaattgaataatgtctcaagttagtttacagtttggatagacaaagttattggtacggtattattggtacggtattatgaatataaaagggggctgaaatgatatacaatatgtgttcgctaagaactaaaaatgttacttacccctttcttagtatacccaccaacgcatatggatcgtttttacctcagtttgatggtaattcgatccgtgtccgtgctgatctatgtgcttcggctcctaacacgacgtttgatacatacgacagacgacttgcaccctcgtgatggtgttgttgttagttgttatacatgaaaagaaagaaagttattagtattaggaataaacaggatttagtgagttttcattgaattacatttgactacatcgctgattatagtcaacgacatcggaaactttatgtgttgactgttgatctagtttttcctcagtcccgttggtcagtattgctaaaggtcctttttaacatgtttattggtacttggacaagttgaatattttaagtttactacttttgtcatgttggtcaataatgattttgatcagtttgttttatacatctattcaaattcaaatctggtctcgtctgttttcatttagaatcgtcgtaaatacatttctatgtgttaaaaactatactagaaataataaaggaatagaaagtcatttttattgtccggatccacttttcggtgacaaaaaaaagcttcatcgcgcctaagcctattatttataattttgcgagaatgaagttgttgtagttttatgataccaacataataaatgtggtttttttattatgattctaatgagagaagcataacaaattaacatttgtgtcacattctactcgatggatcctcagtcattctcctcattagtcagtattataaccatttaaacaaaatctaacctatctgcatcaaagcgtggctacggctcctgttaccccgatgcctggtaacaggataaccgttggatcacatccgtaagattgatgcatctatgccagatggttgatgacgcggcattaaacaaatatttcctgatgtgataccaccacgactggacatgtctttggttcccatataagtgctaatggggtaagcccacccatcgcggcaagattacacgtcctaggggagggactttgcaaacgtactttagaattaaatttttcttgagcctaccgcaatgtatttagtaggtcaatatcagcagacaaattacgtgtactgacgtgaagacgctcggcagctccgaatcagcagcattttaagacgagttcatttgggatcaaccataggttgaaaccagttgatcaaactgtttattttcttttcgagaactacatctttcgattttttcggattattcgaagattttctatgcatacctctagaaaatattttagtttaaattaacagtgaacacaatttagaatcatataaattcggttgattctccataaattcaaattgaattaatgtcattgctttttgggaaactgttattgataattaaataacagtttcctaaaaacaagcacattaattcaatttgattttttgagaatcctgaatttactaacacttatttattttatttatttatttttatttatttattttatctttacaaatcgtgttcaatagcttttagtgacacttgcagagatttggtccacctttcaactgcgactttaaactatttctttttagaatatttcaatacatttttgacgtaattagactatatagggaaaaataacaaaaaaaacccttaaaataaattgagcttaatctatatcacagtggttgagttgcaagattttctataagagggttcgctgacatctggcatgagataatgaaggtatttgttgctcgttcgatgaattcgtcgatggattccgtattagatagacgatgaagttcttgtgtcgagaagaaggggtccaaattaaggatcattttcagcaacttattctgcttcatttgtagacgttttcgatgcgatttggcacattttgcccaaactggggaaccgtatgtcattataggtcgaagtacacatttgaacaacagcattttgtttttggttgataactttgaacgccgattaattagcgaatacaaagatcgggctgacttgtccagtttatctatggagtaattcacatgtttggcaaatgtcagtttcgagtcgaatactactccaagatatttgccttcatctacccaggctgaagcctgtccattcgtggttatttctgttcttggaaggcttcgagctgcccgtttcctggtgaagagaattgtttgcgttttagttgcattgattttaattcgccatttgcgctggtattcttccagggtgctctgcgcatgttgaagtttcgcaacaatttgagttggatccttgtcggcagctaagaatgccgtgtcatccgcaaaaaaggcatacactactccgtctaccatcagcgtatcggaagtaaaaatgttgtacagagctggacgcaggaccgatcctataggaacgccaaatggtatagagtgtgtggtggacctagaaccgttgaccactacttgaaattttctatcagacaggaacgaatgaatgattttgaccaagtaaagtgggcagttagtttgataaagcttgaagactacggcctcctgccataccgagtcgtaggctttttcaacatcaagaagaaccataccagaagattgtccgatgttgaagttccttttgatttcttgtttgattctcaccagttggtgaatcgtcgaatgtccttttttaaacccaaaccacagacaaacagacgtcacactctcatcatagtccatcgaccacctttttaacggtcgattcaaaaatatggtagttggcctatccgccatccgcagtgctcgcatcgtttttgttcgcatttgacgtttacacattaccgccatctgttggcccatcggccaaacacgcttattttagcattgggcgtacatgtcctcgtgactatgattttgatcgggatttgctctaagtgttacgtctgtttgtctgtgcccaaactgttggtgtggtataactgtgttggtttcgatgtgccggttcagtctactcagtatcaatctttctaggattttactcaggctactcaagaggctgattggccgatagtttcccgggcacgtaatatttttgtttggttttggaattgcaatcacagaggcatgcttccatacactcaggcaaatggactatcgataaacataggaaccccttataaaaattcgccacaagaaatcggattgaaattcataaatttgccttatgaaaccagaatttgaaaacaaaaaacgttttcgcggcaacctggaatcgaaccaagaaccttgcgattgataggcccgagcgtacacctcgcgcctatcaacgccttgatgtgagttgatgctaaaacgatacataaagcgttcgtattgcaataaccgttccacctttcataaggcaaaatgtatgaaatgcgatagtccagttcgctgcgtgtacggcaggaaaataagttgccttgagacatgcgttaaggatcttcgtcaaagccacgagtgcttttttcggatggtgtttgagaactacatttttgatgccatccaagccaggagcttttttggtcttcattgaacgaattatcgacatgatttcttttggcctggccaaaatactcggatgcaaagtacattcaccatgtttaacagtttcgatggtactgttcacttgtaatgtagtctgtgcatctctatcaagcgtgttgacgtgtgcagtagcaaaggaagtcgcgaatgcttctgccttttgagtggagctgactattagcttttcattcactttaagcggtggactgtactttacgtgatttcggaggcatctgctaattttccaaaatttattgcatccgttatctaggtttttaagcaactcttcaaagttcttatatcggtgatcagcacatttactacgaattataacattaagctgttcgactatcaaacccaaaagcggatcacgtgttcgcaggtactggcgtcgacgagcattccttaggcgaattaactgtttgatttcatccgggtcattccgtcgatcattgctgctaaatttgggaacgctcgcttcttctgcacgcgttaacaggtcgccaaaatatgagatagtatcgtcgattttgtttgggtcgtctagatcattaaaccaattggagtttaggtcgatctggtcgtttatcattctggagaagagactccagttggcacgattgtagcaccgataagtacgttctggtagagtagtaggagcgccactactgatgttgaaggttactggtaaatggtctgacgagagttcagtatgggttacaggaacagacatttgaatccggttgtttgacagcaccaggtctaaagtggatggccttcctcgtccaggtgggtaacgtgtcggcgtttcagggtagtgtatgtagaagtttgaagactggtattcctgaactaaaactttcccagccttgttcgatgtagcgcagttccacataggatttcgtgaattaaaatctcccacaataaaatacggatcatcagaacgagtaaggcttcggacatcacgtcgaaattggttgagatgcgcctttttctgcgatccgggataatatgcagcaacaatgttgactcgggttgtgtctgagatgattgatacaccgacggcttcaattattgatgtagagaggtcaagttggttgaacgacagcccctttttgattatgatcgcaactcctccaccacgatctgtgtctaaacactggcgatcgagtcgggttactgtgtaatttgcatgaaacagagaattgcggctacgtagccaggtttcggtcacaaccgcgacgtcaatgtggtgagattctaggaaatgaaagaattcttccaccttgttgtttaagcaacggctgttccaattcaacacctttagtgaattatggctgtccattgtagacgaatttgagaacaagctctgccagtgcagaaaattgcgaggcccttgtcttgcagtttgaaagttttacaaatagctctagggcaagtgcagtaaactcttccacggagaataatccttgatcgaccgtcggctcggttgatggactgtttcgacccctagcaacgcttgcgtaagattcgacttgagacgagagagctgatacgatttcgatgggttctagactatgttgattctgcggagctgtatgctggtgtaattttacagggctagtaacacctttctcccaactttttcaatttcaagtagttcagacgtgaggggcatcctttgaaattggccgtgtggttttgactacaatttgcacacttgatgtgcgctttcgagttcgagttttcggaacctacctctggtctcgtaggtagttggcaatctttagtgagatgacgttcgccgcatttgacgcatttggcttggaggttgcagtttcgcattccatgaccgtactgctgacatctgaagcattggactgcatcagatttttttcgggaataaaaacgccagtataccacgacgttgaagagagatttgatcttgctgagctcctgtagttttacagcaccttttagaagttgcagtaaatacgaagcgacgtctccagtttttgttgcggataggagtttgatttccgtagccaccacaccgttgttttccagttcggttttctcatcattgacatcatacttcgggaggccagatagtataaacttgtctgggatatcgtcactggttccgtgagtgaagaactgaacgtcattcgttcgtaatagattgacagcttccacaaagtgcgattttgttttgatgatgatttgtatgttgcttttgccgactcgaaaaaggtaatccttctggttgatgtttgttgtcgataataactggttcagctgtggcaccgttttcccgtacacatgtatcggagggcagcgaactttacgagcgagttggacgctggcagcagtagtttgttgatcaggaaccatccatcaatgcgttttccagtccttcgaaggcgttactggtagggacgttgatgaccagctgttgcgtctctgatgacatgcaatcaggatccgtcggcatcgttgtcggagttgatgaaatttgcccgtcaccactaccagagctgcaacgggggcgctgaaggggtgcttcaggaactacaagagagctgcctaacatagcatcgatatggtgagttgaggttaggcgaactttgctcttatcatagtttcttcggatgaggatattcgctgtaccggacggtccagcctctccacctgaaccggccgaagactttccttgggtgggtttccccaggatgaccgctggatgcgccaaaaatcgagaaaaataactttcgattcgcactgccaaaaaagggtgtttactcctcgatgttagacagttgactcatgtagctgtttgaatggacattatggacctatgcacgagttcagtatttgacgttttagcggtgccgtgttatttatgtgaccatggaaatcagtgaattcggcaccgctaaaacgtcaaattagtgaactcgtgcatcggtccatagcactgaatcttcaaccaatgagccattttacgagacgtttcggaacagctgatcgccgcaacggcgtcaattgacaggagacctgggattaaatccagcgtgattttcaacaacgcctcatcttaccaaacgtggacatggagaaaatgacaaaaatgagatccaaaaatgttcgttactgcaacattacacctagttattgtatcagctacctctttgttacccatattgcacatgaaaaagcacttttgtgatcagaaatattttaataatttttctccatttaagttttcgcctggatgaaaagctacgctagagatgcgcacagtcatcaaccatcatcatcgcgaaaactgacgacgatgattgaaaaatcccaagtctcctgtcattcactgaaccaaggaatcatgtcagatttatctgaaaacccatatagtttttttccatctagcttttcacataacgctcattaatttatcacataagcttgtgcgatttctttatgatcaaatttatctgataaacaacatacatttggtgcaaaattatcatacgaaccattgaatgttgacaatgagttttatgtgaaattcagatgacaattattgatattgttaatgatttttattagacatcataatgagtttgagatgattcttttttcagtagaaatgatgaacaatgcaatcgtagttaaaaaacagtttattttatacattgtcgccatttgtatgaataagctatgttttaattacattggataatcgtttcattgagctctgaataattaattctttttcatggtgtgtttctttcgaccttgctccattggcttcagcttgcaataaaattgatgttttctgtaaaatcaagtccaaaagaatattttacattattttttatagtctaaatatttaacttaccctttatttactgtttatcaatcccaaccataattctttgattcacatcgctttcaaatataatttacttccaaatccaccacgatgatttttttagggttaatctcgccatcaccaaaatgctgcaatgactagattttcacatctgcaaatcccatagcattcattggattgaacacatgacttttgttcatatacgtttcacagtattgataattgaatattatggggtttcataatgagatttatgtgtttcttacatgaatatcaatggacacacataatgtgaatcggatttcacttatcgtaagagtatgtgacgtttttaatattttctatgatatttattggttcagtgtttgaccaggcttcgtaaaatggcttattaattgtttacgttttgtagataaccctcttttcaaatgtttcgctagctgagttaaagattaaattcaaagaccttgaacttattgtttgtctattttagaaatgcccatttgaagccatcaccatcatcaacatcccgagtaacttggacaaacatacgactcatcgttactcgaagaactcgttcaagctgcatcgtttgccgattcctcgaccgggagaagtgctgggattggttggccagaacggtatcggtaaatccactgcgctgaagattttggctggaaagctcaagccaaatctgggacgctattccgatcctccggattggagcgaaattttggcccacttcagaggcaacgaattgcagaactatttcaccaagattctggaagacagtctgcgggctttgatcaagccccagtatgtggatcagatcccgaaggcggtcaagggcacagttgcggctctgctggacaaaaaggatgaacgaaacaatcagaaggaaatctgcgcaatgttggatctgaccaacattcgggatcgggagattcaagcgttgtctggaggagaactgcagcgttttgcctgcgccatggtttgcatccaggatggggacattttcatgttcgacgagccatcttcctatttggatgtgaagcaacgtttgaactgtgctttgaccattcgttccctgatccacccggacaagtttatcatcgttgtcgagcacgatttgtccgtcctggattatctgtctgatttcatctgctgtctttatggagttcctggatgttacggtgtagttactatgcctttctccgttcgcgaaggcatcaatatcttcttagacggttatgttcacaccgagaatatgcgtttccgtactgaatcgttgaccttcaaggtatcggaatcggcttcggaagaggaaatcaaaagaacttgccactacgtttacccatcgatgaaaaagaagctaggtggttttacgctgaccgtcaacgatggtcagttcagcgattccgaaatcattgtgcttctgggtgagaacggtactggtaagaccactttcattcgaatgttggccggtaatctggagccggatgaggagtctgaaaagttgccctgcttaaacatttcctacaagccacagaagatctcacccaagagtcaaggaacggttcgttggttgctgcatgagaaaatccgggacgcttacgtgcacccacagtttatcgccgacgttatgaagccaatgaagatcgaggaaattatggaccaggaggtgcagaatctctccggaggtgaattgcaacgtgttgctcttgttctgtgcttgggtaaacctgccgacgtgtatctgattgatgagccttcggcttacctggactccgagcaacgtcttattgcggctaaggttattaagaggtgagtttttgacgtgttaacataatagcaaattggatcgtttttctcggtctctagaagcaacactcattacacaccaacactattccttattcatttggcttagagtgcaattcttaccagttccgatcaatcacagagaaacaaccattgcctgacatgtacagtcaatgtgtgctttgctatgttaacataagaaataagcaactaaacaatccctttcatatttcagatacatcctccacgccaagaagaccggtttcgtggtggagcacgatttcattatggcaacttatctggccgatcgggttatcgtgttcgagggaaaaccatccgtcgatacgaccgcgcacacgcctcaatccctgctgaacggaatgaaccgcttcctggaactgctggagatcacattccgacgggacccgaacaacttcaggcccagaatcaacaagacgaactcggttaaggtgggttcagaatctggagtttttttttctatcgaaaagcataagctaaactattttttgtccattcacaggatacggagcagaagcgcgcaggtcaatacttcttctacgaagagtcttaaattccaccgggcgcgcacctttagaagcctcttcaactggtattagtctgagccgggagctgtctcgttttaccccatggaaggaaaattgtattcattttttaaaccctactacaatcagcgatcacgcttgtattctcttttggatggaataaagaagcagaaaaatgttgcaaaaaggcgaaaaattgtggaagtatcgtatgatgaaccagaagccatcgaaaatgtaatagaacgatgtacccgatttgtattcaattgtagaatgtttatttaaatcctgttcttgaaaatcagttgtaggacgagttgaaaagttttcgcaaaaaggcagcattgattacgaactgctccgaaaaattgggaagttagtgttttacttatgataaaaagtgaatttattgtttatgcttcttactatttgtagaataaatctggtaaaaatgacagtgctgttcgtttattacttatttctggcattgccattttctgagcatattttgttgattattcacttaggtgcaagtttaaatctgggcaaatttcgatagtcaaataaatgttcggattgttgtcagatcctagccaaatatttgacaccgtatactgagctcagtccctctcaaacaacaacaacgtatactgagcttaagatggcacatgttagaatccaaacatggctggcacaatggccggcttgtgcccctacggcccctactcacgatttcaaaggcactaatcttctgaaagaattaacgtacaaactcaatcttattttaaactttctaactctagcagtgcacaaagctaaactaggtataagttgtagtttgatgcttctttcatgacatttgtgccttcaaagttttggtgtattattgaattttgattccaaactgtttcacctcaggaaaaccgatttttttttcaaaagtggagcagttttgtgtttacttctatcgcaaaatggataaaagaacgaacatgtataacgcaggctctgacttgaaatttttaaggatgcatgttcaatgattcg

SEQ ID NO: 176 - DNA, 22554 bp, Aedes aegypti
aaataaaatcatatgaaatagcaagaacaaaaacggcaacagtgtcagaagttaggttagacatcgctagagtagaatgtagcagagtagggtagttcggtcacttgaccagttcaggtcaactagttttcggtcggcaacccggcttgtgaacttgaataaagaaggcggaaggccatttattcgaagtttactttttggcttattttctgtagcaacgtccgagcagagtcacccgaaaggtcctagaggacacggaaaaggtattggtaagtaacagtaggaaagtggtgggacccccttggtttctcacttcctgctgctggtttggctctgccaacaaaaacagggtgcacactaaaagtcgaacgttttatagcttgcataggggcttgttcatatatttcataacggttaaattagccgttttggaccccctcttgacgcttttcgtattgaaagtctactatttttgcatgagccgtaacaacgttcggacgaatggaccctaggctcattcgacattttgtctttcgacgttttatcacccaaccttcggaaacaaacgtgtttttagtacaccttaattccacattcctacccccaacgaaacgaactgacagtgacatttctagctgtcatcgttctctccctctccgtttggtcccatcattcgcgaattttctgatgcattattcacgtttctccttcactgctctgtgggtgcgtgtgtgaaattgcaccacattgtgtcgttaccgtgtgttcggtggaatcttgccaacaaaatacgttattctgtgctaataaccgtctaaatttgtcacgatgccaccgaaaaagaagggaggcaaaaagaaccaggactgggacgatgacgaacccgaacagaaggcagtagtcgatccgccaaagccgactggtaagggcaaaggaaaagcgaaagctgtcaacgtggattcggatgaggaagttcctgcccccaaggcgaagaagggaggtcaggcagttccagtgccggccaagaagggagctaagggtaagaaaggcaagggcaagaacgacgactggagcgatgacgatgatagcggaaaggacatgaagattggcaagggtgaatcggaggaggacgaggaggtgaagattgcgaaaccggctcagaagaagaaacaagcggccaagggaaagaagggaggcaagaaggatgacgactggtctgatagggaggagaaggagattaggttggatgtggaatcggatgaggagcaagaggtgaaggtcagcagtaaagcgaacaagaaaaagggaaaggcagcgaaggtggtgaagaaggtatcaagcgaagaggaggaggaggacagtgaagaagaggaagagagcgaggaagagccggtcccagttcctgtgaagaatgcgaaaggtgccaagaagggaggaaaggcgaagaaggtggaatcggaagaggaaagtgaagctgagccggagccagtgaaggttgaagaaccgaagcctaagccagaaccagtgcctgcgaagaaggaaacgaaaaaagaagacaagaagcaaaaagtagaacctgagcctgtaccggaacctgaaccagagccagagccagaggcgaagaaggaagatgtcgcagaggagttggcagacaaagttgaagaaatggccattagcaaggagaagaaactaacgcacaaggagaagaaaaagttgaaacagcaggaagagttccagaaacagatggaggccatgacccgtaagggaggtcaaggacactcggatctggacagtaacttcacaatgtcccaggcgcagaaaagtggaaaccagagcaaacacatggagcacgccgtggacattaagatcgagaatttcacaatctcagccaagggaaacgacctcttcgtgaatgccaatctgctgattgcccaagggcgtcgttacggtttggtgggtcccaatggccacggtaagaccacacttctgcgtcacattgccaatcgcgtgtttgccattccgccaagcattgatgtgcttctgtgcgagcaggaagttgtcgccgatgaaatgtccgctgtcgatacagttctgaaggctgacgtcaagcggacggctttgctcaagcaatgcaaagaactcgaagagcaagtggaagccggaaagatcgaactgcaggaccagctccaggaagtgtacaatgaactgaaggcaattggagcagattcggcggaaccacgagctcgacgaatcctggctggtttgggtttctcgcgtgccatgcagaatcgagccaccaaggacttctccggaggttggcggatgcgtgtttccctcgctcgggctctcttcatcgaaccgacccttctgatgctggatgaacctacgaatcatttggatctgaacgccgtcatttggttggacaattatctgcagacctggaagaagacgctcctcatcgtatctcacgaccagagcttcttggacaacgtctgtaacgaagtgatccatctggacaacaagaagctctattactacaagggcaactattccatgttcaagaagatgcacgtccagaagcgtcgcgagatgatcaaggagtacgaaaagcaagagaaacggatcaaggagctgaaggcccacggacagtccaagaaggcagccgagaagaagcagaaggaaaatttgacccgcaagcaggagaagggcaagagcaaggctcagaagacggaagaggacgagggaccggttgagctgctgtcgaaacccaaggactacatcgtcaagtttaacttcccggatccgccaccgttgcagccaccgattcttggattgcacagtaagtaacacgatgctggactgctggtagcgagtcgctttttagtgattttgtcattattttgacctggccactgataaagtcactgtactttctccacaaaaattgccttcatcaaagtcacaattttcgaggatctgatgatttctaatcgttttctaaaacacaaattgaattagctttccaaattgaaaccgcaagccagtaattacactgcggaacacgtttttgtctccagcaccaaaataccgctattcacttaattaagggttgctgaatccattgccgttttcagaaatatcatagcacgtctagtttttgagatatcgactgttgaaaatgcaaaaaatgactatttcagccaacttgcatgcaagtttgccagcttgtaaggtaatatattggcttaatttgccacagaattcaaactttatgtgtattacaatacttatcatttaagtttgtaatactttcgatacggaaaagttattttttgatggtttagagaattgttgtattttgccatatagaagaaacgaagaattttgtatggagactgcaagcatgttgaaaaaatcgatttaatcgaaatttaatcgcactatttcaatcaaattatgtctgaaatgaaagttcaagtcctattttgcatgtttggtggattagattacaaaaaagtttgataaattgtacttttaatttcatgtaaacattaataaaaccagtgttttatacaactttggcgacctgtagctaaaaattgtgacgtgctggaacatttctgagaatggcaccagattcagcaatcccaaatctactagagacacataatttgatccttgagacacgcaaaaatgtcatttttgttacgctgtgttatagaacgttactggaatttcataatttatttatttatttatttatttatttttaactttaatttagaaagagggaaaaaacccctttgagtgattttattttaaaatctttctcaaaagggcgcaaaacctctttatcttttcaaatacgttataaaaagaaaaataatttaatactaaaggcccatccggaaaggattcattgcagagccgaagtcgtcagataatggatgcaaatccccatggtggtaggcaatgaggtaaccaataaattaatcaatctgaaagtaaaaataaacaaacatatacaaaaaagagagtatcaaacatgataagagatttcgtttaaaaattcaaatatatttttcattatcagaaaacatttctgagccaaaacatctcttactgaatttggaatttcatatcccaaatttattatttgattgaaaagattgtttctaggtaaaacgtaacgagagcattttaatacaatgtgatcaatatcttcataaaatctaccatattcacaaagattggaatcatttaaattcatacgatatagataacaattgcaaatataatgattggacattaatctagaaaacgaacatatgaaattacgttcaacagatatttttttaaaccaaggaattgtactaactttaggacaaatggaataatgatatcttccttgattacttgtatcccatgaagtctgccaatttttaaaagaatctttttttaatttagaaaaatattcagaagggtaaattacacgtttatatgttgtaccacgtaaaacacctaattttgccaaacaatcagcttgttcattgccgtatatattgcaatgagctggaacccaaactaatttaactaaaaatcccttggaatgtaattcatgtaaaatttcttttagcattaatataatataatgtgttttgaaataaaaaataatagaattcaaagcacgaagacaacttaaactatcagaacatttttttttttgtatggtattcagttggagctgcctgacagcttaacttgtcaaggtctggcttttgccaagttccccttctaccaggaccaatactcagacggactaggcaatggcgcccacatgaacactgcttttttattagtattgtgacgtggtagtttttgaaaagtacccatattcccttgcttctgagaaaaggaagcattatgaaaatcagcagctccattagaatttgtttgaaatagtagtgcattactaatactgtctagtcgaaatggttttgaataatttgtcattcaagtgctattctgattactattgtcttttacgtaagattagagtcttaaatgtcaagtgtcgtcaagtcttaacaaaattaggctgtttagtagtagttctagttaatttcattttttgttgttaaaagtatttattggtcattacgttcatatatccttaaagaaaaaagtcactttccttgtctgttcagcaatttttcgaaactagcaagtataccctaatgatcgatctcagcgtcttactttccatagtcatttttatagtaaatattgaagagtaaagttaccttaggcttctattacagtctcctacaagattcacttttcggtggcaaatgcaatgcttcacaacgcctactttctacttgtaaattttgcgaaaatgaagctggaattagattatttataagagtggctacggatcattctgatgagcaaaaggcaaactgaacgtcaccaatagtattaatgtccacttcgaatagattaattcttgcgaaacattactaaaggacctatctaacattgagaggctctctttgtttactttctctttcattaataactgagtgacattaacctcttctgttgtgttttttgtatgaaacgctagtcaaggaaattgactttcgatctatagtgaaaaacttcccaaaatctttagtattccactgttataatggaaagagaacgagagaggagagaatctctcatttgtacataggtcctttagtaatgttccgcgagaattatttgaaatgggcatctattctataaatgctatgccatatgaattatgacgcagctttaagcaaaaaatgccaaaatgtgataccaccactacaggttacgcctttggtttccatcatatgggctaatggattatgccctcccatcgcggcaagatcgcataacttaaactatcagaacatattatgtatatattgggagcgcaagatttgatcaaattgcatgcaaaatataaagcagttaattcagctatgaatatagagtagggtgccaatgaaaatcggggggggagggggcgggggtacatgaaatttcagaaatcgaaattttttttttgatgccagatgtcttagaaatgcatgaaacgtcgagatctagtgttatttgaaaaaaaaaaattttttttaaatcgaccttttgggacttgtaaacttttgagttgggggagtgaattgaatttaaaatgaacgatttgaattcaattgctgagaaattcaaggcaatagtattgaaacatatcctatatcattgttggccactgaaagcatattatatgtgatatttcataaaggtggtttatttactttccattagggtggtcctttttgttaaaaaataaaaaatataaaaaatagaattttaattgaatatttaagacaatagtattggtacatctctctgttaaatgtagaaacatgtggtattttattagggtggttcacttattttccattagggtgggcatttctttcgaaaaatcataatttgaatgggatattaaaaacaatagtattttatcacctctttcaacatcgtagggcatttccttcattagattcgtgatattttattagggtggctcacttattttccattggttgtttgccgaaaattaaaaaaaaaaatcaagaaattttaaattcgatccttttttttagcacaatagtattttaacacctcttttataatcgaacaccgcttttatttcgaagaaaattttaggggaaatacggaaggaaattccaaaggaaattccgaaggaaattccagaggaaattccgaaggaaattccagaggaaattccgaaggaaattccagaggaaattccgaaggaaattccagaggaaattccgaaggaaattgcagaggaaattccgaaggaaattccagaggatattccgaaggaaataccagagaaaattccgaaggaaattccaaaggaaacgaaaattatagaggaacttccgaagaaaattccaaaggaaacgccgaagaaaattccgtagaaaactgcaatgataaattataatagaaactctgctcaaaattccaaaggaaattccatatgaaattaagaaaaaaattccataggaaactcagaaggaaattcctcagaaaattccaaaggaaattccatatgaaattccgaagggagctgcaaaaaaaaattccatagaaaatagaaatttcaaaggcaattccgaaggattccaaaggaaagtccaagtgggatttaaaaaattccgtaaggaattccaaagaaattccgaaggaaaatccaagacaaatttcgaaggaaattttcaaaataattctgtaggtattgcgaacaaaatttcaagggaaattccgaaataattttcaaatccagaggaatttccgattccagaggaaattccgcaggaaattccagaggaaattcggaaggaaattgcagaggaaacgaaaattatagaggaacttccgaaaaaaatccaaaggaaacgccgaaaaaaattccgtagaaaactgcaattataaattatactagaaactttgcacaaaatttagaaggaaattccatataaaattggaaggaaattccacaggaaattcccccgaaaatttcaaagaaaattccaaattaaattccaaagcaaactccaaagtatttccaaaggataatccgtaggaaacttggaaggacattttggaagaaattcctatgaaaatttcaaaagaaattccgaaggaagttcctatagaaattccatagaaatttccgaatgaaattccaaagtcaattccaaaggaaactcctaaggaaagtccaagagggattaaaaaaaaaattccagataatgctgtagatatgccgaagaaaattccaaagaaaattccgaaataatttcaaagcttcaaaagaaattccaaatgaaataccgaatcaaatttagcaagaagctccaaaaagaattccaaaggaaactccagaagaaattccgaagcaaattgcaaagtaaatttcgacgaaaataacgtagaaaattccaaatcaaatcctgaaggtagctccaaaataaattccaaagcaaatcccgaaagaaattccaaagcaaattcaaaaggaaattccataaaaatgaatccgaatggatttttgaaggatattccgaagcaaattccaaagaaaactcggacaaaaattgcgcagaaatttccaaatgaaattccgaagccagctctaaaagaaattgcaaaggaaattccataagaaatttcaaaggaactttcgaagcgaattccaaaggaaacgccgaagaaaattttgaagaactgaagaaggaaattccgaaagtaattccaaagaaatccaaaataacttcctgaagcaacttactgaaagaaattccaaaggaaattctgaagtaaatgagatatgaagttccgaagaatacaaaggaattttaaaggatactcctaagaaaattgcgaaaaaacaattcgaaggaaattccaaagtaaattccgagaaaattcaacggaaattccaatgaaaattacgtaaaacagtccaaaggaaaattccgtaaaaaattccaatcaaaacttctaaataaaattccgaaatctccataggaaattccaaaggttattccaaaggaaattccgaggaaactctataacaaatttgaaagtaaacttcaaacgaaattccgaaagaaatttcaaagagaattttgaaggaagtaataaataaattccaaaggaaattctgaagaaaatttgataagtagcctcaaagaaaactgcaaaggaattttaaaggatactcctaaggaaatttcgacggacactccaaagttaattccgaaggaaactaaaaaaaatccaacggaatttccgaagcaaatttcagaggaaattctgacgagaattgcgtagaaaattccaaaagaaattctgaaaaaaatccacaggaaattccgaagaaaattccgtggaaaattccaatgaaaattccaaaggaaaatccaaaaaaacccttaggaaattccataaaaaaattcaaagcaaattccgaatgaaatccaaaaaagaatttttaaggaaatttcgaagaaaaaatcacagctccaaaataaattccaaaggaaacttcgatggaaactttcaaaatataagggaaatcccgaaaaaaaaaactaaataaaattctaaaagaaattctgaagcacattccaaagaacattcccacgacaattctgaaaaatatccaaagcatattcaaaagcgaagttctaagaaaattccaaagcaaatcccgaagcaaattccaatgaaaaaaggaagttaaaaggaaatttcgtagaaaattaataaggaattttctatggaatatcctaagcaaatttgtaaggaaattctcaaaaaaaaaaactctgtagaaattccaaagaaaatttctaggaatattccgaattaaatttcaaaggtccaaaagaaatccctaatgaaatatgttaacagtgtcctacgatgatgtcgcatatcaaatgaaactagaggtgcatgaattcagaggaatttaaagcctctctaaacaaaattgaagacaatggcctacgattataaaagaggtgttaaaatactattgtttttaatatcccattcaaattatgattttttgacagaaaggcccaccctaatggaaaataagtgaatcaccctagtaaaataccacatattaaatgtagaaaatggcttacgataatgtgagagatgttccaatactattgtcttcaatattcaattaaaattctatttttatttgtttttattttttaacaaaaaggaccaccctaagggaaagtaaacgaaccaccctaatgaaatatcacatataatatgctttcagtggccaacaatgatataggatatgtttcaatactattgccttgaatttctcagcaattgaattcaaatcgttcatgtcaaattcaattcactcccccaactcaaaaaattactaagtcccaaaaggtcgattgaaaaaaaaaatccaaataacaccagatctcgacggttcatgcatttctaagacatgtggcatcaaaaaaaaaaaatttcgatttcggaaatttcatgtacccatggagatttttcatgggtcaaaaaagccaaactttgaccgctttgggggtccactcaatgaagtccgattgagctcaaattttgcatggggacttttttcgaggagacaaaacttttgagcactaccattttttgaaattcgatgacaaaatttttcccatacattccattggcaccctaatatagagctagggaattctaacttgaaaaaatgagccaattcaatattaaatacgacaaaccctgctgtactatcaattagagaaccatcagtgaaataaagttgttcaggtttaatgccaatgaatttccgattgaataaaatactagcaacatgagaatgcaattgataaggtacatatttcaattcttcatttaaagttaaatcaatacatgggcgaaatgtatgaacatttatgctgtatttataaaaactattattaactgtaatgatattttcagcattacaatatataaaggaacttaagagcacagacaaacagacgtcacactctcatcattgtctatcgaccaccttttaaacggtcgattcaaaaatatggtaggttgccgatccgccacccgcagcgctcgcatcgtttttgttcgcgtttgacgtttgcacactaccgccatctgttggcctgtcggccaaatacaataattttagcattgggcgcacatgccctggtgactatgattttgatcgagatttgttctaggtgttacgtctgtttgtctgtgttaagagtctacaagtaggattgatctcgaataaagaattcaatatattaattataggatgattattcgaaaaacattgtattaaaaatttacaattaagttcatgaaatctgtttctaagtggcactatacctgccaaaacttctacagattttgtatgagtagagtttaataattttaaacaaattcttaaactacgatattggattttttcaagtttagaaaattgtgtttgaatagaacttgaaaaagtgaaacaaccatattccattaccgaacgaattcgaattgttgttttataaagtgtaattaaatcattagggtgagcaccccaccaagtgcctgtaatcgtacgaaggaaattgattcgtttgaaacaatttttttgaaaatatttgatatgattattccaatttaattttgagtcaaaccatataccaagatatttataatcaaatacttgttcaatttgatagttattaagaaataaggtaatatcaataggagaatgttttcgagaaaataaaataaatttagttttttctacggaagaagtaaatccattttgatgagcccacgtaccaatgttatctaaagaacattgcataaaatgttgaataacttctctactctttccactaacagaaatcaccttatcgtcagcaaattggataaaattaaatccatttggaattataaaagcaatatctcttgtaaataaattatacaagtccaaaataactataacgtatcattcgagaagtaccatcatgaaaaaaatgcatgatttaaaacgaaaataaattgcataaaaagttggaaataaatggtggaatcttacaatcattcatttttttgaatagcaaatctatgagaactgaatcatatgcaccagaaacatcaaggaacgtagaaactaaatcctgctttctattgaacgtaagttcaatttgtgaagctaaaagagaaatacaatcacgagatccacgaccttttctaaaaccatattgatatattggaaaaatattatttttttcagcccatagttccagccgattcagaatcattctttccatcaatttacgaagacatgataataaactaatcggtctgctactatcaactactgaaggatttttaccaggtttaattatatattatgaagcgccattcagtaggaaaaatattatgggaaatgaatgagttaaataaagaaagtaaatgtaatttgccttctagaggtaaattttttaatacaataaatttaatgttaacgcggtaccaggagcggtatttttggttattgataaagctaaatccatttcttcaatcgaaaattcattgcaaagctctggaaaataattatgagattgtatgtttttgaaaggaatattggggggtacaaaatcaggacaaattttagaagcaaattgactgatccaatcttccgaatattctgaaatgtttggtgccgaagcatcataatttctcaaattacgtgcaacagtccataatgtagataaagatgtctgagaatcaagatttgcgatgaaattcctccagtaatttcgttttttatatttaatagttctagtaaattgtgcctcggctttacaatataaaaagtaatgttccctagaacctgaacgtcgaaaagttttaaaacagttagatttatgttttaaagctatactacaatcgttgtcccaccaaaaagatggattatttattctacgtggactaaatttttttttcataagttgagctttacgtaaacattcaatcaataatttagaaaattgtttataattattaattggagaaagtgagttatcgtaattgattagagcaaaagaaattaaatcagaaaattttgaccagtcaacattttttgtcaaatcaggaacttgaaattcatttgaaaatttatcacggattggacggattttggacttcaattattaaaggtagatgatcacttccatttggatcattgtttgaacataaagataaatcgatacatgaatgacaggcgggaggaacagcaatcctggtaaaagatccatcattaagaatattgagatttaattcatcaattaaatccatgattaaagatcccctaccatcagttttgtcacttccccatgccaaattatgtgcatttaaatcgcctagtatgtaaaatggagaaggaatattatttaaaattgatttgatatcatttaaagaaaaacgtacattaggaggtatatacatacaaataatagaaaattgaaaaccattatgttttacaaaaattgcaacacattcaatttgcgaatcagtaactaaatttaaagacctaaactcaatgttttttttgaattccaatcaaaacacctccataagaaatattacgatcctttcgaataatattaaatgacggaattcggaaagatttggaatcctctaaccaagtttcattcaaacaaaaaatatcaaaattgaaatttgctataattgcttttaacctgtcaatttttggaattatactacgacaattccattgtaaaattttcaatttattggaatttaacatagccattacaaggaaaaaagtgaactgatgaggggtccaaacgaacttagtttttcaagtatagatgctaaaagtggtagaaattttttaataatatttttccaaaaatcactcaatcctaagaattctaataaatcttccagaatgctcaaaatagaattttcatttttgttgtttgtgttttgagaattgtttgagtcatcattaattttctgaaaaccaggaatattttgatgtggcttaggattatttaaaggaggaaaatcggtatcaaaagatgttgaaggctgtggaatagaaatatcaacatgatttttattggatttataaattctttttctgttactaggaggtttataaataaaactattttcttcatgattcaaattttcattatcattatcggataaatgttcaaaaatattagtaagatttgaattatcagatgatttgatgacttcagaataggataacttatttttatttttaattgattgattatatctttttttttaattttttttattagtatcattctaaacattacattcatttcttatatctaggtgttctgtattattagacaacactatcatcctaatttggtaaaacaaatttaagatttaatttacattttgttaacaacatattgcatttcatttgccgtagcagttcagattttttacaggtgagtttatttcacctgcttataagagaaaaaaaaacgctttgaatatacttaacctaacttaacctaaacatattacgcattaatcgtggcaatagaagatttttgcctgaaattatttattattaattttgacatttgttcaaatgtttcaacattggatattgtatgtaactcattggtactataccagggaggaagcctcagaatcattttcaaaattttattttgaattctctgcagagctttcttcctggtattacaacagctagtccatattggtacagcatacaacatggctggcctgaaaatttgtttgaatatcaaaagcttgttcttaagacaaagttttgattttctattaataaggggatagagacattttacatatttattacatttggcttgaatgccctcaatgtgatttttgaaagttaaattcttatctagcataagccctagatacttaacttcatctgaccaatttattggaatccctctcatcgtgacaacatgtctacttgaaggtttcaaataaagagcttttggtttatgtgggaatattattaattgagttttggaagcattaggagaaatcttccattttttcaagtatgaagaaaaaatatccaaacttgtttgcaatctattacagatgacacgcaagattcgttctttggtaaagaggcctgtgtcatccgcaaacaaagatttttgacatccctgaggtaactcaggtaagtcagatgtgaaaatattgtataatattggtcccaaaatgctgccttggggaacaccagctcttactggaagtctttcagatctggagttctgataattaacctgaagtgtacgatttgacagataactttgaattattctaacaatgtatgttggaaaattaaagtttttcaattttacaatcaaaccttcatgccaaacactgtcgaatgctttttctatgtctagaagagcaagaccagtagagtagccttcagatttgttggaacggatcaaatttgttacacgtaaaagttgatgagtggtcgaatgtccatggcggaatccgaactgttcattggcaaaaattgaattttcgttgatgtgggccatcattctgttcaaaataaccttttcaaaaagtttactgatggaggaaagcaaactgattggacgatagctagaagcttctgcaggatttttgtctggttttaaaattggaacaaccttagcatttttccatttgtcaggaaaatatgctaattgaaaacatttgttaaatatatcaactaaaaatgataagctactttctggaagtttcttgatgaggatgtagaaaattccatcatcgccaggagctttcatgtttttgatttttttaataatagttctcacttcttccaaatcagtctcccaggcattttcgaaaacgttctcttgacagtgccgtagcgtgcggttggccaggttggcacccgccaagggcgccagcctacagggagcgccaaaatgcgtgaaacactttttatttattttgaagatattaaattagggaatattgaatattgaaaaaatcttatcagtaataatttcaaaagaattattgcacataatatagaaatatatgaaagtcgcttgcgctacctctaaatcttaatatttttggatgcagagtagcggttagagcagtgaataaaagaaaacacgtgtggttctcttgggtgacaactactgaatgatgatttattataatctaaatgtatagcagtgtggtaacaaatgcagtgtgcgtgttggtgtgtgtgaggtacatcgagtgaggataaatgggataaatgagataaaatgttacactgaaataattcgctcttcaaattgacaacggtgctacagggttgtgtagcccgtcaatctgaggtttcccttttcacgtgattcaaatccagaagagcacatgaatttttggttttgagaactttcgaaaaataagccgcaccctaatgtgaataaatctaatataatcctgagcgggatccacgaaaatctgggcagaatttcaacagaaaattggtcaagattctctcaaaatcaaggacaggattctaagcaaagctctcgcttcgtcttgatcggtcttacacataatttcaagtatcattctgaaaaaatgttgagtaatttttaaatcttcatttgattttttactgctcgaaaattcccacagcagacataattttagaatctataatacatttttaataatctaaagaatgttctatacaagctgaaactcgtttggtgtttcataaaagattgtagtagaatggttgaatgttactttttacacctcttcgatattttttattaagatttgacctggcagtgattgagatttttcttgtttatttgatatttttttcatcgaaagtatatatggtcagctttcttctaatagatcctcgattaaccttctcatccaccgtggctttcaattaaaatgatcttaaaaaacttttaaaatttttgtaaatacttcctttttatttggtatcttactgtgaaaacagctttcaaagacaatggttatatcgattatcatttgaatacataattgaggggctactctttgatgtatttcaagtaatttactattgattagttacaaaatttgtgatttccacattgctgttttgcaataacacttctagaggaaaacttgactaaatctacgcaaaatttataaaaaaagttcttatcgaatcttaaacaattttcttcggtttctgtacgaatatcttgaaaaatgaaatatatttgaattttttttcttttcgaattctatttcgggcataagctcctaaattctttctagttctttaggacaaaaaatttcaaaactctgcctaaaaacagatggatgattgggaggatttctttaaaaaaatgtatttcaccataatttgaaaattttgcctgaaaatctaaccagatgaaatataaatttcttcggaatttttcagagcatctttcagataacattcaaaagttctcagaaaattttcattggacaaataaaagaataaacatattttcttggcagattttagtctatagtgtaatgcgttctgaacttaagaaaatattttaactaattatgaaacttttgatgattttcataaaaattcttgtagaaatcgctcaaagtgtttcaaaaataatttttgatgagctttgatttaggggcgctaaaatggaggttcgccaagggcgccatgataccacgctacggctctgtctcttgattgagaatattttcgaactcctgagtaacttcattttcaattggactagtaagtcctaaattaaaattgtgcgcactttcaaactgcatagcaagtttttgagctttttcgcaattagttagtaataatttgttttcctctttcaatgccggtactggcttctgaggttttttcaagattttagataatttccaaaagggcttagagccagggtccaactgagaaattttattttcaaaatttttgtttcttaaatctgcaaaacgtttcttgatttctttctgcaaatgctgccatataattttcatagcaggatcgcgagtgcgttgaaattgccttctcctcacgtttttaagacggatcaagagtttaagatcatcgtctataatcacggattcaaattttacttcacattttggaattgcaatgctcctggcttcaccaatggaatttgttaaagtttcaagagcattgtcaatatcaagtttagtttctaaagaaatgttaacatcaagattggagtcaacatacgttttatatatattccagtcggctcgtaaataattgaaagtggagctgataggattgagaatcgcttcttgggatatttgaaatgtaacagggacatgatcagaatcaaaatcagcatgagtaatcagttggctacaaagatgactagagtcggttaagaccaaatcaatcgtagatggatttctagaagaggaaaaacatgtggggctatcagggtattgaattgagaaatatcctgaagagcactcatcaaataaaattctgccgttggaattactttgagaattattccatgaccgatgtttggcattaaagtcaccaatgacaaaaaattttgacttattgcgagtcaatttacgcaagtcagtttggagcaaattaacttgctgcccagagcattgaaaaggcaaataggcagctatgaaagtatatttaccaaactgtgtttcaacagaaacacctaaagtttcaaaaactttagtttcaaatgatgaaaacagttgatgttttatacgcctatgaatgatgattgcaactcccccacatgccccatcaagtaatgatcgacttaacaaaaaagttaggatctcttttgagtttagatccaggttttaaatacgtttcggtaataactgctatatgcacgttattaaccgtaagaaaattgaacagctcgtcctctttaccattcagagaacgagcattccaatttaaaatatttaaattattatttggatccattagagaaacgtaatccaataacaatttgatttgtaaattttacacctacttggactgcttcagtcatagtggtggctttgaacattgcatcaatcattagattcaattgttcagttaaaaaattaaaatcagaggcagacatgtcatgtgattgattatatctttgttgatgagcaatgtgaactgaacattcttttaaagaattgtgttttcctttacaataaacacaaacatcagatattttttttacaatttatagaagaatgaaaatcaccacatttcgagcattttggtttattagaacaaaaattcgaagtatgtccaaaaagaaggcatcgattacaatgcataatttttggataataaagcctaacatgaaatttgacattgtcaatcataacataatcaggtaacacagaaccttcaaatgttattttaatacaattggaattggtataaatagagtctatataagtaaaagtcaatttagatagacgattacaatccaaaattttaacagatagcatagctttatttttaaaacatcctaatccataatttaaaatatcctcacaatttaagtcctcatcatacattacaccatttatttcacaagaatcgcttggtgcataaactcgatataaattgaaaaataatttggattctaataaagaattggtatcttcacgagatccaaaaataactctcaatttgtcaagagaaatttttttgattcccttgacagatttatatgttttataaatttcagaagaaatcaataaaacatttatcggtttatccttcttacggaaataaacaacgaatgggcccaaaaatgttgagggatatgttttgactcgaaatgatttttctgcagaacatgattcctttggaattatattctctgtagaattgtctccatctccgtcagtctctatgataggaagaaaaaagacggggttgaataataacttaataataaatcaaaaagaaaaaaatataaaaattatacttaacgaacgccaatcttgaatattaaacgagtggccaaaaaattccaccagcagaaacaggaaaaacttccgtcttgatcgctaaagaacgattcctccacttctacttcttctttgattgatacgcccacgatccactggtcgattgacaaaaattttccgcctctccaacaaatatttcagtctcgatgacttcccttccttgtctcttctactatcttctcccaatcacttctcttgtacacgatgcagaagtattcgtagttcaatttcacaatcctcgtagcagtttcacacctgaaaaaaacaggaaatatgacaagcgcagagaaaaaatcctccgacgcgttcaaggcctacttaccagatgaatttcattatttgaaaatgcaaacttttttctgatctcgaaataaaaaaaaaagtccagagaatagaagcgaactgtctggatgataggatgtcgtgctatttgggcacttccataatttactttgacaggggaagttttctcggccgaattgtctgaaattttgtaataagaagcacttcaacgcgatgcaaacattagctcagtagctttcaaaaaactccatgcgtttagggttcttggagtcatcgattgattgtatcctctttttcagatgttaacttcaacttccccggtcaaaagccactgttcatcagcgtggatttcggtatcgatatgagcagtcgtgtggccatcgtcggaccgaacggagttggcaaatctaccttcctgaagcttttggtgggcgacttgcaaccatgcactggagaagtcaaacacaaccaccgcctccggatcgggcgcttcgatcagcattcgggtgagcatctgaccgcggaggaaagccctgccgaatatctgcagcgattattcaaccttccctacgagaaagcccgcaaggctttgggaactttcggtctggccagtcatgcccataccatcaagatgaaggatctgtccggagggcaaaaggctcgagtcgccctggccgaactgtgcaacaacgccccagatgtcctgattcttgatgaacctaccaacaacttggacattgaatcgattgacgccctggcggaagcaatcaacgagtacaagggaggagtcattattgtgtcccacgacgagcggcttatccgagaaaccgaatgtgccctttatgtcatcgaggatcagaccatcaacgaggtggacggagactttgacgattaccgaaaggaggtcctggacagcctgggagaggtcatcaacaaccccagcatatcggccaacgctgccgtgctgcagtaatcaaaccaattgttgtactcgttcatattattagcttctattttacatccttttgtataatttaataaacctatagttaagctagctcaatcgagtccagcaattgcctctgctgtttcgttatgcgatggaattcgtttcgactcaaatgccggagatcacttaccggtttccgccaaggccgttccttgcatccgaatcgcagctgttggctcttttgccttcctccgaatcctcctcccaatcgtctcggtttccaccccttcaacctccgttcccattcctcatccaccagaagctctttcccttccaaattccgtccgtgcatttcatcgattgccctcagcgcacttttcctctcactgaactccacgaatccgtatcccctcgacagttccgtcaccacatcccgcaccaaacggcacctcacaatcgtcccaaaacgctcaaacaacttccggaactggttctcatcaaccgagggcgccaaacggcccacaaaaatcgtacacaacggatcgccaacgactttccggttcggcttgtaactggaattcatggcccgcaccaaagcccgatcgtgcggaaactcatccgtgccgtctatggagcccacctttatcggatcataaacgtcgcgggcgaattttgtccacggtttcgacgaagaagacgacgacaatcgcggagaactactatcgcggtcacgacgggaagacattgtttattttcattgattgttttcgtttactttgtagcataacttctgccgtgaacgtgctccaatgtgtttaccgttacacagggtggccaggttgcttttttttttgcatcatcggtataggcctattcacatgacgtctccaatcagctgatcgggaagcactatgacagttcttctatcaaaatggcaggcccgtgttagcaccggtcctccaccgatgtaaacaaatgcataggcggatctgtcacatgaaaaggcctataagagcccattcacaaatttcataacgctaaagggggtgggtgcactcagatataaaaaatagtcacagaattactaaagtttatgcattaatgactattttctatctgcctctctttcattctgtgtttttacactaactgtcaattcgactgggttgaagcttagcgatgcttcaacccaggcgaattgacaaataggaataaaattccctgcatgatgaaagagaggcagatagaaaatagtcatatattactaaaatttagtcaatctgtgactacccgtgtttctgagtgtgtgtgtcctggtaatgttacgtatcacacaaaatttataaaatatgcatacaaaaagtgttacaaggggtgggtgtcgaatatgaccgtttttgacgttatgaaatttgtgaataaaccctaatgcgtagtatgcacctgaaacgtaaagcgctcaagtaaagtttctcctttttacc

SEQ ID NO: 177 - DNA, 19009 bp, Aedes aegypti
tcttatgtttgggtggaaagaactcaactttgcgttaaatcaacccaaaattgagtacatttttctaatggaattaaagccaaactacctagtggggaccttggaaatttagccaaaattgagttattgggctcaactacggaattgagttgaaacaacccaaaattgagttgaattccgtctccgtgtaagtatatatttacggtttggtgtatttcttccgcttggccagatcctcaatcaagctgtgcgatttatcatcgatcactgcatgcgccaccactcccaacaggtgcggcaatggggcccttgccttgatgaccggtttttccacttcgacgaaatcttcatcttccatttttgtttgaattaaagctaaagttcaaccaatggagaaaacacgaaattttcaaaagattttcgattctcaaacaaccatcgttcgttgccgggacaacgcggatggcagcgctgcagcgaaaaatcattttcgaacatgaaatgcgcccggcaaacattcacccgaaatgaacttttctgaggcgacgccgcaccatccgtcacccgagcggaaactgatgtgtcaaacccccaaagttgttcttttccggtaacttgtgttgtttgatgaacacattttcatcgttccgcggataatttccagtaagtttcggtgttttacgtggtttttctgcaaaatattatcgccatcgattggtttaaagttcttgttatagtgttgaagtggaatttgggctaaaagtggtgattttgcaggattaaactgttgtcgaaaattagcttccctctaaccaagcaatgtcactttttatttactttcagaaatggtaagcgatgggattcaaggatgagattccggaaggatttccgccgtttggaacccgaatggacagtatcaaaagaggggtaacggtttgttgatgagtgttgttttgtttttaggccaccaaaaccgcttcgaaggataaatccaagaatattatgcgcgatcttcggatccgcaagctgtgcctgaatatttgcgtcggtgaatccggtgataggttgacccgtgccgccaaggttctggaacagctgaccggccagacccccgtgtactcgaaggcccgctacaccgtgcgttcgttcggaatccgtcgtaacgaaaagattgccgtccactgcacggttcgtggattcaaggcggaggaaatcctggagcgtggtttgaaggtccgggaatacgagttgagacgcgacaacttctcccagaccggcaacttcggcttcggtatccaggaacatatcgatctgggcatcaagtatgatccctcgatcggaatctacggtctggacttctacgttgtgctgggacgcccaggtgagtggaaccgtacgacgattgttaactctagcgtcctcgtcgtgaattgtgaacgtcttttccgtgatttcgtttttgtaaaggaattctcataaaatcggaagtttcgaaacgatgcacttctagtatttaattgatgcatatagggtcagtgaagtaaaaccctaaacaggtcgtaacgtgtccaaattccaaacaaacgatcgacatcgaacggatcgaattacacagtggtcccgaagtggctttgagacacgaattcaaatatgtagaaagctaaagaggaacgattctttcagaagaatagcatgacatcaaaaaccgtgtgcctgttactttcaattcccgatcaaccagtgttacaacttatttgtaaatctttgttcagcgatggcgatcgccaacgattcaaaacgaatcgatattgatcgctattgaaaaccactgactggttgactgattgaggacagctcataaaaaatgccaataggtgtaaaatacttgttcagtttgtctactacctgataaaatatgggagaattttggccacaatcaggggaattgttgtgaataagtgcattctgcatacaatttatttaataaaaatacgactttaaattgttcagaataaaacatgtttaacctagttctaggatttaagattacaacgctggtaaagaacacttcaattatcagttccatttgattgtcgttcataaacaacgtggattgagaacatgcgtatattatttttcaaaaaggttttttcgaccattttacaaaaataataaaattataggaaaagggcaaaaattagaacaggtacaaaaatggtttatttcctcgagatatcattatggaataacataaaaaagccaaaaacctccagagaaaccatattaggtgcacttttgtccataaatcataaataagggaaaggattttttgttatctttgggttcgtattcatataaaagcaggatgtcgactacctcagaaagttatagggaattttatttccgaactgcagggctggtagcgagttacttttaatgagttgtagagataccgaatagtaaaaattttattattcggccaaacgaatattcgaaaaagaaattcgatcatcacacaaataaattatttgatttttttttcttcgtttgaaacataatgttttatttcaactttgcttatttttaaattattcggtcactgttcggccgaataatggatttcattattcgacagaccgaatattcggcaaaatccaaataatcgagatattcggtacatctctaatgacttggtcacctttttcgtcctgatcactaaaaagtcacttttaaaaaaaatggccgctaaagtaactatgttcgtgatctcatgataataaaaatatcagaaacaaacatatatttgtatacagagtcagaattagggcgaatgttaagacttttgacctcgtcctttctggtttgactatcatcagcttcgccgttttgctacgttctttccccagaaccttcatcactatcgaccttctgctcacttcttccacactcagttttaaatgcgccctgctgccacacgcaatctcaaatgcgcccggttaccgcaggggggaagttgggcgaaattgacatcagagttcgtatcaaaagaattctcaaatgcgcctttatgtttttttttcacttttttcgtgaaaaactttatttttaagaaaaagatgtgaattatatgattgtaatttatcaactaaagtgttaggcgaataaaattcagtttgtttacaattgtcagttaggcccttaatctggtactgtattgatttgttcttatgacggcaaatatagtgtaatttggaaatcaaagtgtcaacaaacataggtattcctggctaattttctggcagaattcaggtgaatatttcgtagaagattctgacaaaacttgggaagcaactttgggctgaattttctagccgaaatatttgaatatttttttgcgaaaaccaacataaaaatcggacagatctgcagaacaaaatattagtaaactatctgctgtaatctgcggctatagtaggaatcttaaacctgccttatgaaagagcctcatcaaaactcctctgagaggtatgccataatccataggttcccaaacttttcgagtgcgcgacccacctagtcgtctggcaaattcttcgcgacccaccaggtgaaaaatgttgataaattagttttccactgaaacttttgaagtctatcgttacttcattggaaatgacatgcaccaagaacgtttaaattacagagttaacgatgttgctaacatttcagtgttactaattctcgttcaattaatattgttcacatcgaaatattaaatttcacaattaaatttcaccataacacaattttaatggatatataaactttacataggattttaggagacaagaaagaaagtttttcttaactagaaagttatctattttgtgatattttgatagttaatttttgctgagcttgaaattttagtaggtcggataaatgtatagatttgtactacatttctgtttcaaattcctgaaacatacagtaaatttagcaaaattgaaatttgaaatatttgttcaaagagatttatcactaatactgggatttcatagatttttaatgacttgacttggcttggaatacatgaagcatgagtacgatttcattaagcaagcggcaattgtggtttgattccgccgacttattgttccattcgtcaactcgaaatttttcttgtatcgttaaacgttattcagtactctctacgttatatacgcaaaaagtgaaaacttcacgctgctgctgttaatcgttcaaaatcacagaactcccagtatttgtgctaaaattcttggaacaaatatttcaaatttcatttttgttaaatttactttttcagaaattttatacataaatatattatgtagttaaatctatacatccttcccaactccttgtacagttgcgttgaagtgaaatagttcaccatatttacgcaaaacttttcttatacgagaaataaggattgtttgtaacaaaatattctgacagcttcaattttcttttcaagtgtcttgattatcagtaaattataaaagtttttttttcccgacccaccagagaccagctcacgacccccctgggggtcgcgacccacagtttgggaaactatgccataatcggttagagaaaaaagagtgtcagaaactcgtccaggacttaaaaaaaatatatttaggaattacattagagttacaacaaaatgagctctacattttccatttgattgactcttgatagtaagccggatcctattcttggcacttttgattcacttcggcagtgggtttttttgaaagctaatgagctcatatttggtcacaatatgcgtcctattgaagtgcttcttttagcaaagttgtatacaattcggccgataaaaaaaaccccatgccaaagtgaatcatggaagtgctcctcaagtagctctgcaaccgtttttttcacgacattggttaaaacttctacacaaaaaaaacgtttcttaatgaaagcttgaacattggttgacattaataaatagtgatatcagtgtcgaatccacttgttcatggctttcagcaacaaatatgcatctaataaacatagattgtttttttaaaagaacggtttcaatatttactgtttgcctcattatctaagtaaggtaccgtggggcaagtgggtaatgaatttcgcatagttgggattcttcaaattctagagaccttaaattaaaacaaatgaggtcgtgtatattttttagcttgactgccaccaaatataagcagtatactgatattgatttttatgtaaacttaaagaaaaaagtacagaaatagttttcgaaaaacgtctaccacaggtggggcaagtgaaaagtttatcgttttgaacaataaattcaaaaactaacagttacattcacgatttctattacctttaacatttgttaaggcgtcccaatgaacaataacataagtgacttggatcgagtatttcttgaattttcttctgttcagtaatgttggtggggattgctcatcaaaccttccggtccgcctcatagttacgtactatttggtgctgggtgtagttcttgtttttccagctgtattgaaaagcatgagccatagtctttggcatacaatcggatctatctttagcagaaaagaaccgaaatgtctatcgacgaccggtgattgctagcagatatagtggagagcttgtcttgaaacgttcattgcttcaagctagttgaaaaactgaatacactgattgcctgtcgatcagagccgaactaggcatagatcgtatacatacatctgaatctacatgtctccgatgtattacatcgttccaggtgggagttatctgatatgtgaatatggtaccataacagaattttccatctgaacgaagtgataaatcataatattccgcaaactgtatcacacatctacagaatgtattgcgtgaagttaagacacagcagagtattgggtacataggaccaagtccctgccgggtggcgcgaaactgatgagcgatagacaatagaatcaacaacactgccataagggatagtaagcatgtgactattgtcgaaactatgattaggaggcaaatcaacatcccaagatcaaatttttgttacaacccaatgtaggtattattaaattaggctgtagaaaatgataaatatctgatcacttaggaaccttgcaacaggtaataaatgctcgtagtctgttttcttcgaatacacatgtataaattgttaaaattgccgaatcatacgcggaatttattaaacggatcatgaaattaggactgaaatcataatgatgatagattatcaactttcctttcgtcttgctatttgttaccgttagaatcaccaaactgattggtttcccactacttacaccaatacaacagcacgaaaactgaagtattataatcgcgcgttggaactttcaatatccatatattacatcaatagtgaattcttgtatgtagccagtataaataaacattctttaactgaaaacaggatgcttgttttatcaaacatgctcaatctgcacctaaaatctcggatccaaatagttttctaaataaaaattgtgtctaaataaaacgtgtaggccaacaaaacataattgagtgggagtttacaagttacttagcacatgaaaagcagtttaaattaatctattactagatcaacactaatgctcacatttttatattctcatttcatcatggtcctcattgctcgagcggagacgaacaccctggagatggaaaaaatcgacagcgctacgataaggaaacgtaacagatgagaaactatcgatacatttatcaattataaaaccccgttttaatgttaacactttgtttctgttttttctgtttttttcgtttcagcaatcaaataaccgaaccaactctactatcttttcatttcttcttcgttatacttatagtccttctggcactgaaccgagtggtgcgccttccgctttcttactggtgctgtttttcctgtacatttggcatagtgtcggaggtggtgtactgtatttgctatacaacgcgctactttcgatattgtgcttggcgtgtggggaagcagtactagtgatgaagcggagggcgccattcggtttagtgccagagggactatatctatttaatgtatctgaagcttgtgggaccgctttaattccggcgcctgcttgtggaagatcccggtgtgctaaacggtataggacatgttaacgggggaggcttggtaggtcctcacccagcccgtgtctagatgggcggataattgtctgccagggtgtggattgagcaattacaattacaattttcttctgttcagtaatgtttgttgaaatgattcgacaacatcataactgcaacatttccaatgtttgtttttacatcatgggacagcaattgcatttctgctctgtagaatttccaccgctcgttatttgtttttaagaaaatcggatatgacgtcggataactcttcaagagaaatcaaacggaatccttcaatgaagtatttagaaacttttttatgtggatacacctataccccatttttatgttttaaactagcattacatagacattctaaaaaatttccgtgctttctcttatattggaacttttcaatcaacgtcttccttttaatcggctgtccgaggtaaacataaaattatcgtaatttttggcaacgtattttttagagaagatttgaccatgaaaattgcatttaacgatttgattataatgattcttgaattatcagatcattctgttgttctatgataattgcgaaccttgtatactaacagctacttaaagagaaaacacaaattcaatatttaatgaagaacatttcacttgccccacttgaatagaaaattgacggtgtttcaatttgattatttttagttctattatctattctaaaactttttttttgcggtttaaaactgtcagagggaacatcttagaagtggtacagaaaattattttccgcaaatttttcccactgaaaatattaaaatacagcttatgctcgataactgggctgagagaaccttccagttagcgagcagtgctcgataactggactgccattccaacgcacacacacattcaaataaaaatcgagggggacttagatgcaaagttttggttggcgtcattcggttttggaatcgcgtcgtgttcgtgtcattccgtcattgaattcgcgttttaatcgtaccgtcttgtaaattttgaggtgaattaaacagttttcgttcctgcaatggacatcccaccgggcaccaaccgcaaacggaaacaaaaaacccttacgttggtggaaaaagttaaaattatcgacgatttcgaaagaggaggtggatattgcacattgaattgaaaaaaaaattaaaatctaaatgaaaaaagacaaatttacaattaaaaaaataatgccgaaaccttattttgcatttgcacgcccctcgtcagttacgggatggtgaaagtttctgacgtttaactgttttttaactgggctacagcccagttagcgagcacccagttaaaaagcagcccagttaaatagcacccagttatcgagcattagctgtattcagtaaaatataccaaatattttaattaccccatttacccacttaccccgcggtaccttacttattagataatgtttatggagaagaaatgatttaattctgcagaaattttgctacatattcagcctgattttctaatttttgtttattaaatttaggattctgttgtgattttatcggaatattttgaaattcattcacgattttttattgaaggaatcagaatctacaaacgaaaatttcctctcgaattattcctcaaattagtaaaaaaaatctcaagtgagtagttttgttcatctgcttcaaaatcttgaatgaattttggccagtaagttccatgtgaatacgaatttcgctaaaaattttatcacaagtttgttttccagagctttggatttgataaaatgagagttttttttaaccctatcccgcacatgaattttgtacatgattaaaaatagaaatgtacatatccgcgcaaaatcgttaaacccttgtctttaaactaggaattagtgtacgaggtaatttaaaataaaatttgatgtggtgctctgatgcaccaccaggaacatagagtactttatgacttcatcgtattttttcagatgttcagtttgcacacataggaaaatattgctgtcaaagacaaatgtaagatattttagaagcagcaattatgatttgtataatatacaaaaactaatgcattaaagtaatgtaaaaatcgtgtttgttaagtttatgatttgtttcgcgttctattttcacttttatgcgtgtttaaggggacacgggagaccgtgttattttccctatctttcgtctcactctaacaataatcatcaaaactttgtggaagcaaatctcgagttttagtgaaccgatgaagctgaaaatttatcgggttgtgcactacatatttagaaccatagtgatacattttagcatcgatatatagagtggttcttgagatttgcttcttgaaatggatagggtgattatgatgacgtcccgtgcggccttaataattgatgaataataatttattgtgattaatgtaacataagcccaaacaaatacaaatacgcacactaagagagagtacgtggcgatggcattctttctttggaatgccaaaataccatcacgattgtcatctgactcggcctggattggaataaaaaaacgctcatgacaataatttatcttaagaaacaacgggaatttgacctttaacgcgaaagtctcgcaacattagttgattttcgaaaattcatatgacaatcacagtaatttttaaatatttttttatgaatatggtttgttcatttttgagtcgagtcggcaaaaaaattgtctaaccgtttagtttcaagttggacgtttttatggcttgctgattgctccggaaacaaagttacagcatgccaaaatcggcttccactactattattctgaacacaactgtacttcgtcaaatccactcaaagcatcataaatcttcatcgaaaaaccctataaaacttttttcataaatatattgacgatatttttttttattaaaatttgcaaactgagctgataacaacaataattgtatgttgaatgtaattgatatgataatatttcgaaactacgcatattatgtgtacaagttccatcaaattcaattattgcgaaacagatttatgtactttggggaacatatgttagagcaaatgaagagtaaatctattggagaataattgtattgcagctctcgggattaattctattcgatatataaggcttcgaaattctacaatattttattcgttaagacacattacttcataccttgtttttcttaaaaaaaaacatgttgaacgtattaggcattgaagtaaaagaggagatgtacaattataaggaagtatgagaacaatttgatgtttttcgttatttttaaagacacaaaggttgaaaatgttggtgctctacagacaccatctgcgggaaagggttaagatttaaataaaaaataaataaatagtaaaattaaaatagtatgcccagctaatattcgtctcataaaaaaatgagcaatgaaatcttcaatgcgtcatgttattggtcatttatgacaatcaagtcttgtccctgacagataactgctagaaatatttcaagttaatgtagttcactacattctaaatatgtaaatatgcatttggttgatatccccatagaacgtaatttccatttctagtcctttttatgattaatacttgtactttggagtcactttctagccactattttaataattcaagactgacaattcaaaaggcctcatctccaaaaagtaaataatgagaaaaatgcaatcttgttttgtcaaacaataaatcaaatttaaattatgaatttaagcattttatgttattttatcgtccagaaagtcgatggataaactgatttatagctatgaatattcattactatcattttagcaaaaaatcctgctaaaaaaacgagtcaaaggaaatgagacttttatttcaccaaaagctgtgcagcccttttcatttgtgcccatagacgccggccgacgctgatgaggcctgtgagttgacgcctttgtttactctaaaatgtgttgaggccttctagttgtggcttgttttttcatcatcttcagatgtggccttttgaaaatcattcaaaattcatgataaaatacactgaaccaaggaatcatatcagatttatctgaaaacacatatagtttttttccatctagcttttcacataacgctcatcaatttatcacataaacatgtacgatttctttttaattaaattcatctgataaatcacatacatttgatgcaaattcatcatacgaaccattggattttgtcaatgagttttatgtgaatttcagatgaaaattattggttttgttagtgattcttattaaatattaaaatgagtttgagatgattctttttcagattttttcagtagaattgatgaacaatgttattataattttgaaaaatctgtttatttgatacattattggcatttgtgtgaataagcgatgttacattggattatattggataaccgattctattagctctgaattcttctggttggtttgttctttccgaccttgttccgttgacatccgctaggaataaagttgatgttttctgtaaattcaagtccaaaagaataaattcacatttattattttcgtttataaatatttaaataacgttttttacttactctttgattatcccaaacataattctgtgattcacgtcgcgttggaataaaattttcttccaaaccctccacgatgattctttgagattcaaattcgccattacgaagatatcgctatagtacaatgacttaattttcacatctgccaatcccatagcattcattggattgaatacatgacttttgttcacatacgtttcatagtgttgatagttgaatattatggagtatcatgatgagatttatgtgtttcttacatgaatgtcaatggacacatataatgtgaatcggatttcaattgtcgtaagagtatgtgacgtttttaatattttctatgatatttcttggttcagtgtacgataattcaagactaacaattcaaaaggcctcatctccaaaaagtaaacaatgagaaaaatgcaatcttgttttgtcaaacaataaatcaaatttaaattatgaatttaagcattttatgttattttatcgtccagaaagtcgatggataaactgatttatagctatgaatattcattactatcattttagcaaaaaatcctgctaaaaaaatgagtcaaaggaaatgaggcttttatttcaccaaaagctatgcagcccttttcatttgtgcccatagacgccggccgacgctgatgaggcctgtgagttgacgcctttgtttactctaaaatgtgttgaggccttctagttgtggcttgttttttcatcatcttcagatgtggccttttgaaaatcattcaatattcatgataaaatacgataattggagtgtagaagagtgttacgtggtaaagcaaggtacatgggatctctgcagcaagaggagattcgtgcggtcgattaagtatgtgatttattcaatcatcgtcatcgataaacataatggatgtgctaagcgagagtgtcgtcgagaaattatatggaaatatttgttcaattgaagtaatatttcaattgaacgttatgtttcatgtaattgtaacgaaatcgtgttgttatcaataagtcgtgaagtacagacatgctgacacaggtattattaggtagtatgatacaaaatacatcactccacaagaacccgacgaaaaatttgattatgttcgctgttgagactatcgctgtgtaaaataatacatggagcggagcggctgaagtataacttgtatctgcttagtgaatttgaaacattttttcgtaattttagttgcaattttgatgtttgtttaataggcctcaactcggtttcaagtaaatatagaaatggggccttttttgggaaaaggccgcatttgcgattaatatcctaattatcgggaaatgagatggggccttttagaaaaatgatattttttcaactttcatgcatatttttgcatgactattgtatgatacagtaagaataggctcttatacacttaaatcagcagaaacccgatttgtttacattttggacttgaggccttttcaattgttagtcttgaattgaagtgtagaagagtgttgcgtggtaaagcaaggtacatgggatctctgcagcaagaggagattcttgcggtcgattaaatatgtgatttatccaatcatcgtcatcgataaacataatggatgtgctaagcgagagtttcgtcgagcaattatatggaaatatttgttcaattgaagtaatatttcaattgaacgttatgttttatgcaattgtaacgaaatcgtgttgttatcaataagtcgtgaagtacagacatgctgacacaggtattattaggtagtatgatacaaaatacatcactccacaggaacccgacggaaaatttgattatgttcgccgttgagactatcgctgtgtaaaataatacatggagcggagcagctgaagtataacttgtatctgcttagtaaactcggtagtaactcggtttcaagtaaatatagaaatggggccttttttggaaaaaggccgcatttgcgattaatatcctaattatcgggaaatgagatggggtcttttagaaaaatgatattttttcaactttcatgcattattttgcatgactattgtatgttacagtaagaataggctcttatacacttaaatcagcagaaacccgatttgtttacattttggacttgaggccttttcaattgttggtcttgaattgtggtcactattatttggctgtatgactgctaccagctctggaactggaaaattagggaatttcacttgaggtcaaggaaaaaataaccgataccatgtcacaatatgcatacgtgttatttcaatacatagtcgttacatttttattatgagatatgaaaatgtaacgacttttttatgaatttctgaaactaggaaagatttttgatataaatgatatagagatgtaccgaatagcactattcggcctttggccgaataccgaatagttgaaatattattattcggccaaacgaatattcgaataatggcttaatattcggtcaaataaaacctaaatattcggccgaataacacccgtatgtgcagtgttttttaagtagggaaagctgaacaattaaacgaagtataaatggaaatgaatgattgtcttcttgagcttttgaaaccgtttgcagaaatcataagttctgagaatttctgtatttctgaagctaggaagctatatcctattgttgatttttgtttaagaaattttggtttactattcatccgacttttggaagtgtttcataaaaattgaggcaaatagacggcagacccctgactcacataataatagaagaacgtgatcagtaggttttgcaaagaatatagaacgtatagaaagtcctgataattgacggactttaaggtgaagatgcatcgaagccaaacctgcatcgaagagcataaatctagagaatctgacagccgttcgcgctgaatatttgaatgattggtcaacaccagcgattgaccagaaagttattttcagcacatacggttgtctggttctctagatttgtgctcttgaaaatgccgggtttagcttcgatgcatctataccttgaaaacaaattttcaaacgcttctaactagccaagcggtacgttacagctcctgcaagatgagattcaatttgaattgcagaaaatggtaacgccatagaacagagaaattctcaatttttcaatatttgacatcaaagtctattcaaggtgcccataaaaagaaaaattcggtcatcatttgaataaattattgattttttaaattttccttacataaacataatatttttttacagtttagtttattttgttattattcggtcactattcggcctattcggccgaataacggattttattattcggcagaacgaatattcggcaaaattaaaaaaatcgagatattcggcccgaatattcggtacatctctaaaatgatacttgatgagatgaacatgcttacaagttagacagaaacctaccaataatcgtgctacacaaaatgtgaatttgctccttagaagctcgttaaatatttaaccttgaatataaaaagcatctctaagtattccactaaggattcctacaactatctcagcaggtataaaacaaaataaaaaaacgtcccacgaatgaggacctcactattaagttcttcttttttctggcgttacgtcccaactgggacaaagcctgcttctcagattagtgttctcatgagcacttccacagttattaactgagagctttcttttccgattgaccattttttgcatgtgtatatcgtgtagcaggtacgtgccctgggaattgagaaaatttcctttacgaaaagatcctcgaccagcgaaatttgaacccacgaccctcagtatggtcatgctgaatagctgcgcgtttaccgctacggctatctggaccccaatcactattaagttatgcacgacaaatattttttttttgacatctcacaagaataaggatgtttgggtagatgtgggaaaattctcaaaaatcctcaatacacttcagaagaactatgataatttttatcaaggactaatatcaaataaggcttattctgcatgaatctgccaagaatattaaaagaaaaatcctctcagattttaacgatattcgctaacaatctcatcatttacagtattggacaaaacatttgcaactttatcgattttccatacaaaatgaacaactttggttagctaattctcagttattcatggaccgattcgaatgaaatttgcacagagctgagttttatcatacatttttgaatatttttctcaatcacgagtctaaaagttataacaatttaactaaaaatacaatacaatcaatacaatttctcttaaaatctgatagccctacacaaaaactgtcttcagcaaacttgttcatcgcgttaaaatttacagccttgctgaagttaccccgaagatattccttcaatatgtttagttatgtcatttatcaaaaatcgtcaaaaaattcacttcagtcaaaccgttactgcttttgaacttgtgattggaaaaatcgctcaaaaatatatgttaaaattcaagttttgtctgatgttctgtgaaaatttcattcgaatcggtgcaaaaataactgagatctagttaatcaaagttggtaattttgtatgaaaaatcaaaaaagtagcaaatgttttgtccaataggggaattaggggcataatggacacgttaagcaaatgttcgttttaagaccattaaatggcaatatttttaatttacccccggctagttttcaagtttgatgttagtacgacgtgccacattcattcatagtgataaaaatcatatcatatgtcagaaaagcgagatagaaaattgggtcgaaaacaaggctggtaaaaaggtatcggggcgaaatgaacacctgcatgaaatttagttattccaatatattcaatgactgtcaatcattccgatatgcaaaagggctctccctcaatcataatagctaaaaagaacctttctgggttcgttactttgctcaaaaattagattcttccacggtcttgcttatatgccaatttgaaactgagaaaaatttcaagtcaaattttgaagaacaattgaagcaaaaaataaacttttataccgtcaaacatttcaaatgcattacagatttcatgcagtgaatgaacttttgatgaaatatgcgtattatcagatattgagagggtgtccatttcgccccgtatgttcattatgcccctaatccccctaatacgttgtagtgattttgcaagatagttgccgagcataatttcataatctgtaaagacagattttttaatgaaaaaggattagaaatgtttcccaggaacatggaccgtgacgtagtttgtgcatgacccctaatgagattttgttcatattcttgtcaaaatttacaatacatttcctacaacatccctagcagattgcttatgaatttcttagtgaactctcaaccgagtggtcttgtaagtatttttgtctgattcatgaaaagattcgccaagaatttctccaaaaatcaagcaggtataattctttgtccttttgtagagatacagcctacgatatttcaaaactcaatggaaatttccaataaattctaggggcttgaaccgtctgtatttgcgcccaagagtattccaaacaattttgtgtgaaccctgaattctaggtgcatcatgaaaaaagcatactaggtatgtagtataattctggaattatttttaaggtattttgaatgaagcttggaaaagatgtgtaatgattgtaatcagttaagtgtatgttatttcgaaccaatattcgactgtgatcttgttttatgcggctaatattcctcaaattccatacatgcagttgcaacgcgtttctgaaccgtcttggaacttggacaggctttcggttttatgagaattccaatttatgttagcgaatatttccctgttacctacctatctattgcacaataattaaatgttatctgttcccttatcggatgacattcagtcctgtgcaaagatcaatctcatcgatcggtggtggactgtcttgtgaacgttttctttacttcagaagctatccactaatcacacaactgaactttgtgttagttagatcataagttttgtcagcgaacggtttcatcattactttacctcaattcctatttccaggatacaacgttgcccagagacggcgtaagaccggcaagatcggtttcatccaccgtctgaccaaggaagacgccatgaagtggttccagcagaagtacgacggtatcatcctgaacagcaaagcgaagtaaaatgcgttccaaatccaagtttttactgtctttgtaataagcactataagtaacacaagaaaaaaatatgaaaatacctgaactctactggtcgatttgctcagcttttatccgaatattcgttattatcatttcaatgtcccctatctaaagagtctagaaaaaatgcaacccaatgaagctcccaactggaacagagcctgcttcacagctaagttttcttatgggattttcctcagatattcaccgtcatcaggcattgcacaattcgctctcattagatttcgaagcacgatcaaagcaagcgaagaaaaacatcctatttgttgcggtccgtgatgtgcagtgccgtagcgtgcggttggccaggttggcacccgccaagggcgccgggcttcagggggcgccaaaatgcttgaggcacctgggatttttttggagacacatttagtaaaggtgtttctgcagccacagcatctagaaaaaaaatcaatcatatatataaacaaatagcaatagggaactaatgctgcgtcacggacaaagctacgtcattattactatatattttataagctttatataaacatgataaattttaactatttttggaacgatttgaacaaaacattttcaaagcatttcagaaggtttttaatgatgcgtaaataggaaatttctgagatatt

SEQ ID NO: 178 - DNA, 6120 bp, Aedes aegypti; identical to SEQ ID NO: 64

SEQ ID NO: 179 - DNA, 5190 bp, Aedes aegypti
  misc_feature (1)..(77): n is a, c, g, or t
nnnnnnnnnnnnnnnnnnnnnnnnnnnnnnnnnnnnnnnnnnnnnnnnnnnnnnnnnnnnnnnnnnnnnnnnnnnnnttcacaaacatttcgatcagaagctagagatctcctcaaagatcatacagttgataaaatatccatgaggactttccgcgataggactgacagctgaaagtgtacatgtaaccgaaacggcagggtaaacaaagcatgggagtgttgtcggagctttacattttcctttgtagtcgaacggtaactccgatcgcgaaacgtcaaaacctcatgataaacaaaaaaccagctgatcgcagctgtctcatagattgccttatagccttattcgctagctggaagaatagaggtaataaactatagaggaagaatgtcgctggcgtcgctgcaggaacatcttttgctggcggagataggcggggctataaatgtcaacgcgaaaaagtatgcagtttgacacttatatacccgacatgtttctgagcgagaacaaagggaacagcagcgacattcgtcctctatagttttctatctctattgctggaaggcagtcatggtccaaccagcgaattcccgctgtattcttgaataaaacattctattatatttttgagtgtactaaaatgtagtaaaagaggcatccgatttagtaattttggtcaatcacttctctccgtgccttcatcctgcgccagtgcagtactagattccggctggacgaaacgttgacgtttgttgacgctcgttttctgtcactcgtctgacaaaacaaacgatggcagccggtccaatcgcggaaagaaatcaaggtaagttttttttttacgtatttttcaccaaaattgagatatcatacaagttttcgttagttgcctcagtcaatattggagtgtgtattgcttccatggtaaaattcatcaattttcaatcgaatccctcggttaaatgaatggttgaaaacggcttaaccttcatcattgacgcttgtttacagatgccacaatttacgtcggcggattggacgataaggtctcggagacgcttctgtgggagatgtttgtccaggccggaccggtggtaaacgtccacatgcccaaggatcgcgtaacgcagatgcaccagggttacggtttcgtggagttcctaggcgaggaggatgccgactatgcgatcaagattatgaacatgatcaagttgtacgggaaaccgattcgggtgaataaggcctcggcccatcagaagaatctggacgtgggtgccaatatcttcatcgggaacttggatcccgaagtggacgagaagttgctttacgatacgttctcggcatttggcgtgattctgcagacgccgaagattatgagagatccggagactggaaattccaagggattcgcgtttatcaattttgcgagttttgaagcatcagacgcggccatggacgccatgaatggccagtatttgtgtaaccggcccatctcggtttcttatgcattcaagaaagattccaaaggtgaacgccacggttctgcggcggaacgtttgcttgcggcacagaatcctctttcgcatgccgataggcctcatcagctgttcgcggatgccccggttccgcctccgatcatgccgatgatgccctcgcaccccttgatgccacctcctctcatggcgccacctccccctccaacaccgactgcagttccgccacccccgcaagctccttcggcaccttccttcacaccgggagcgattcctccgcctccgttacctcctccaattgggcaacctccgctgccgccgagtgccgctccgatgggtatcccagcgcccccacggatgattcctccacccccgtggcaacagccggctcctccgcccccgacgcctccctcaatgccccctgctgctgctccgagacctcccccacccaactggaggccaccgcagccacctcttcccccacagatgccaccggctggattccctgggcagccacggcttcctccaccccctccggtaaccaatttcagtgcggacacgttcaatttctagggagcgcgggaagagtgcgatgggcggagagtttgtgttctagaatcttagctcagacaattaagtggaataaaacttataattataattgtatctaataagtttatagtgtcgaatgaaacccttttaacattggttgatatgttgccggtttattctcttcgtcatgggttgttttcttaaagctatttggctcaaaatttgcaccccacaaaccccctctcttgacgaagagatctgttagtaaagacacgtctgattgtaaacaggtttgaaccgggaattatttattggggtattataaattcatggcttacttcaactcaacatccccctattaagctataagctataatttattgactcctagcgatgcccttgcttcgactaatccaataactttggggctggtaccgctttggtgaggatatctgcctgttgatcaatcgaagcgacatatttcaacggtatggtcttcttttctatctgctctcgaacaaaatgatgccttatatcaatgtgattgcttcttggggaatatcccttctctttttccgctagactgtgtagtattgtgttgatgtatgaattaagagtaggccatgctggagagcgatgacaggaggaagagtaaataaaccattgtgattctatattccaaaacctaaagttgtattttcactctgctacattggcgacgagtgttggtacggatctcattataccttcagttcaaagtttggaggattcgtgtgcaagtgtcttgaaaatgatcatctgtcccccgaaagggagggaaccaaggatcaggtcggaaaaatatatgaagaacaacaaaggtcctgtttgttatactgttggtgaccagagcgtattcgaaactataggtagcctatatattatttaatccgcgatgattgttaagtggttttggttgacgatatgagaaatttgatagttgacggtgtgtcgagtagagacagacaagctgttctaatttcgagagtgcatcgcgggtgattcacgcacaaaagtgcatcaattctatgaaaaaaaatcattgaactattttgagaactatttgtttctcataaacataaatcaatgttggattacacattacacatcagtctcaatgtggtgagaattttcgattttatcgctatcatgatgtcatctcatatatgttgatatatttataatcgcaagtaactaattgtaattttcacctttgaaaaaaggaggaagaaaaccataattttaaaaaatcgtttagtttacaattaattacaatttccttttaagaagattgaaatgagggtaccacattgattgctttctatttctggaaaaaaaaaatgaggaataaatacaacattgtttaaaattgtagaaaaaaaactaaataataattgtacaagtctactaaaaacaaacgtatgggttatttttcaggttttgaaatgcggaaaataaaatattaaagtcgatttttttagaaataaggcttgaaataatgtgtaatatccatttatgaagggttcccaacataagacattaaaagtggtcttcattatatcggacaagttgtccgggacaactgtactggatcagtttgatcaatagttaggaatacgattcctgggcattaggtaaattaagattgacatattggcttaacaccttgcttgaaaaatctgaattataatatattccacataattttgccaacccatgtattggcaatcttctcattgaattattatgtacgcactataagaataagaataagaattattataagaattgggcggattgaatatgaatatggtcattcgttttgtaacttttgtgtattttgtgaattgagttttgccaaacatgatatttctgaaacaataaatttatgtgaggcacagtcttgggcacagtgaagctgctatacaattttagatgcatgattcgtatcataagtttgatattataactaatttgtcgcatttttcagagtagaagatgtctacggtatattttgttttgaaatcataatttgaacttcatttagttgatgttgttacttaattgtgtacaatgctatgaaaattcagaaatgaataaataaatacatacatattggtattcaatgaacaaaacaaaatgaacacacattttacgaaaaaaaaaatccaatcaatattgttgttttaactgatttatttgtaaggataaaataacggacacatataaaaaaaaacctccttgtaaagatgtggtttaactttgttctattcctaattatcatagtatttgtaagatccgataatatattgcataaaataaatgaattggagcaagagattaacttaaaaaaaatgaccactgaaatgttgaactaaactaaaaatatgaaaattgataacattgagatgtatgctattagctttaccttgaaattgatatgaaacaacaataattcgaaaagtttgagttcgcgggtacaaatcaaagccatgctgaagatgtctgagtttgatttctggtcagtccaggatcttttcataaaggaaatttccttaacgtccctggacatagagtatcatcgtacctgccacacgatacacagatgcgaatttggcaactttagcaaaggaagctctcagttaataactgtggaagtgctcattgaacactgaagctgagattcagactttgttctagtgaggacgtaatgctaaaaagaataacgattatctagtagttccggacctcaaatacataaaaatcttggtttgacagggaggtgagaaaaagaaacattcggcccatttctagaatgaaatgaaggaatatacataatgaacaatctagtttcagtttcttgatgataagtagagagtaaagggaatacttcaagtaattccggtctacttctccataagaaacgaagaggatagaaaacctggtccgtttctgtagcaagaacgaagggagattgtggaaattcagcccatttctgaaaagaaatgaaggaataacacaaatcgtccggtccgctcttagccaatatgaagagagtaaagagaacaattaatgattctggtctacttctccgtaagaaacgaag

SEQ ID NO: 180 - DNA, 13340 bp, Aedes aegypti
aatatgctgctggaaacatcattttgaagactgatgccacttggatatagctccgaataatatttacatgattggtaatacaaacatgactgaccatattttccggaaccagtttcacggaaatggtcatatttctgaagattttcaacgaatcatggtcatgctgaatagctgcgcgtttaccgctacggctatctgggcccctcaatttacgcattgaacataaataacagaaattcattttaatgatcacgactatgaacttttacaaatttcaagcttcttgacaatctttggaacatgagttgtagaagccggctcaaataaaaaaaatgttcctgcttacaatttttggctgttcagagaaattggactgataccgaagataaaatgtgtagagagaaatagctatattgaaatatattgaaaaatgaaccaaacacattagtactgtaatgtaagtacaaattcgatataagaaaaactcgttattcaaatctcaatgaaggaagtcactgaagaaacaaatctagtttgatctcattttattaggatttttttctgcagtttgcagggctgaattcccatatggagctaaataataacaaacaaatttattaacatctcttctcccaatctcataatatgtatttacattacgcaatacataatcttttatcaaagatttcatttcacatcggagcttttctctgctagaatgcggcacattgcaaacttacacaaatttttcagtaatgttttaacacccaccctagtatttatgttgcaccagcataacaacagccgtgagttgtttacatgtcgcccaccacccacccgcagcatagtcgcgcatgtgtgcgtgcaaacattttgaccaccaccaccaacacacgcgcaatcggtcgagcgaggaggagctgtcaaacgaaatcaacaaaccacatcgtatttgcatcttttgcagaacgaatggccgcgtgtatttcgtcagtttcaaaaatctactgtattttctgaaaaatacgtcggaaattcatcaaatagtgttaaagtcgggtgctggaatgcattagcagtgaatggtgtcggtttcgagctagaaaggatttaattattcgacaaaaatgggactcggcgagaagcactgggatgcggagggcaagaactacaaaaaagttcaaaaggccttggaggtgagtttagcggatacgatttttctggatttgatcttaatgtgatgaaaatcttgaacaggacaaatggaagctggttccggcgttcctgcagatcaagggcctcgtcaagcagcacatcgattcgttcaactacttcatcaacgtggacattaagaacattgtccgggcgaacgacgaggtcaaaagcgatgccgatccgtgtttctatctgaagtatttgaacgtgagcatcggaatgccggacgtggaggagggcttcaacaataccaagtccaccaccccgcatgaatgtcgccttcgggatatgacctacgctgctccgatcaccgtggacattgaatacacccggggaactcagcgagtggttcgaaataatcttctgattggaaggatgccaatcatgctgcggtcgtccaactgcgttctgactggcaagtccgagtatgaactgtcccaggtcaacgagtgcccgatggaccccggtggctatttcgtcattcgaggaacggaaaaggtcattctgattcaggagcaggtttcctggaacaaaatgatcacggaagactacaacaatgtgatccagtgccaggtaacgagttcgacccacgagaagaagtctcgaaccatcctgctgtccaagcacggcaagtactatctgaagcacaactcgatgacggaggaaattccggttgccatcatattcaaggcgatgggaatcgcatccgatcaggaaattatgcaactagttggcattgatactgaaacgcaaaagcgctttgcgccctcgctgctagaagcgaccaatcataaggtttacactcagcagcgggccctagagtacatgggctcgaagctgatagcgaaacgattcaccacggcggccaccaagtacaaaacgacggcggatgaagcgcgggacttgctggcgacgaccatccttgcgcacgtgccggtgccgaattttaactttcaggtatttagcctagaattgtcaaataacttatgtatttctttaaaaattataagaattgtgaataatttctcctggtatttttcctgagtcacccggcggttcttccattatttttttagatttttgatttaattttcattattttaataatcaaaataaattacgcatctaaggagccgtccattaattacgtaaggggttatggcgggaggaggggttaatcaattaattaattaatggacagccccttaattacgaaatgatcctataccaaccgagaatcgaactcagacaccttcagcatggctttgctttgtagctgtggactataaccactcggctacattcctatcatggtaaaaaatcagcacgttccattgcagagtttgaactcttggtttaattcaaaacaccaatcactatgatttgaacagtccttactttggactagctctattacagggtgtcgactacctggaaaaacctggaaagtcagggaatgtcagggaatttatttttgacctggaaagtcagggaaaatcagggaatttcacttgaggtcagggaaaaaatatcaatactacaacatcaaacgagtttattgtctgcaaagtaattaatcatgctaaatcaatatatcttctgagtcagtatggcttagctttgtagccgtggactctaaccactcgactaaggaaccaggacccagaaaattcttcagaaatgctgaggacgattctcaaagttcctcgattacgtttagtaatccagaaaatcattgaaaagcagaaatttcaggaatatcatttgaaataatcttgataatctattgacaatttgtgatattacttagagatactcgtagatgaattcttagaagagttccttggagcattgctgaaagtacgacaaattcaagagaagcattagaaaccttctaatcagcgcattgttcaagccctgaatgcattccgttgagaatatttagatattttttcggggagaaaagctaagggtaattcaaatcgtaatcctaaaatattacctgtaacgaatcatcgtgaaaaattatcagacattctaagaaaaaaaatgaaaacaatttggaaaaaatctgtgtcatcttgaaaaatattagtaattagtaattaggcaagtacatatatctcaatgaagtaaaagcttttgatcagtttattcatacgacctataacataaatatcatgaaaatcatcgaatatgtatcttgtaaaaatcgtacttatttcggttcaaattaaccaactcagtggtctggaacttttctggaaaatgactggaaggtcagggaaagtcagggaattttattttcaaaattgagtcgacaccctgtattatctctagcactgggctttggaatgaaaagtcgttgattttgaacataatgtctattgtgtgaaagtaatcattgacagctagttgtacatagtaacatattgagttcaattcaaccacctctaaaaaatgcgaggggtgtcgagataagatgcgagttgcaacgttgagttcaagaacagtttctttgatattgttgagattgattagtagggcaaatccaagcgaacaaaaagcgtgatgatttttaccggaattctggttgattagttggtatcggcatcaaatgttcacgtctgtacggttcttccctgataaccggaagggatatttgttagacaaccattgttcctagataccaaatatatctttgcaactccacggttgtcatagataatgtaaggatctgggactcacctttgagtggtgttctgcccctctttgcacaacagtcccatgttggaaaatggcaaactgagaaaatgacgatttaaatgtacaaacaactttgcttcatctcgtgtctccacttgaattaaaatgtgttatatttttaaataatcactgtttgttgagtgcacgaactaccctgagaattttttattgaataaaactggaactctgtttaaaaatgtacaaatagtaaagtgagactgacatgcgaagaaatacaatataatatgccaatataattgcatatcagtcccattgtgatcatcgtcttgtttgacagctactgtttggctaccggttgcttagttcgctgttcgctgttttcaggctgtgaaattcagtaattatacaatgtccgcgttaaaattattacaagtatacggaagtgaaagtgagggtgaatcctccgatgaagaattcatcggatttggtgatagtgatgaccaatttccggccaataattcaaaacacaccgcgatgtggaatgcgctttccgctatcaacctgagacatccggaaaatcatccatcggatagcgcggagatggaatccgggacagaacgtgacgatctatcaggcagcgatgaggaagatcggggatccgatggaagcttttttcaattagaaaaaaggaagcggaaacaaacaaaacggcaaaaattaaaagaaaagcgcacaaaacggcgacggctcagccacaagttgcgcattgtaaaatgcggatgcaagaaaaagtgtgaccagattttttccaaagacgaacgcgtaaatatccacagccgtttctggaagctagaacccaatgagcaatgcaatttcattcgggaaaatgtgcaccgcagctcagtgcaaaccagacgcacgtaccggaccgtagcaaatcatcctaagaaaaacttttcatatactttcaacctcagtttgataaatggtgaaaaattgaaagtctgtcgaaagtttttttttggctgtcattggatacggagaaaactgcgggtaagttcaatttaaatggcatattttaaaacgagtaattattctcttgtttatcttttagaaacatcatttatcgatgcctggaacatgatttcgatggaaacccaaacccgaccaaacgagggaaatacgagagaagcaaagcaaaacgtgaagccgttaagacccacattttgtcttacaatccgtctgtctcgcgttatcgtcgggaacacgcgccgcatagattctaccttccatccgatttgacggaggcttcaatgcatcaagcataccaagattcagccagtcccgcattacgagtcagctaccagttttattgcagtatgatctcgaagatgaacatttcacttgtaaaactcggtcatgaacaatgcgaggtttgtgttactgcaacgctacaccaaaactcatcagggcacaaggaagaggatcgtttcgttacagtgtgttctacttgtaagtcgcatgtagaacattcccggttgaaaaatctttctcgagctgattaccaacatgatggggatcaaatccgggcaaaagaaatagtgttttcagtggacctgcaaaaggtaaatttctttgaataattgtctataaataaattacatcaaactattcggttcttcatcgttttacaggttatccagctaccacgtcttgaaggcttaaaatcaattgtgttcactcaacgtgtgttagcctttaatgagactttcgcacctgttggtgaatatgctaaaacatatctggtcgttgcatgtgtatggaacgaatcaacttcagggagatctgcgggcgatattgcgagctgtttcggcaaagttgtattgtggtgccaagaattcgaaaaaatcactttctggctggacaactgttccagtcagaataagaactggaacttattcctctatttgacgttgttgttgaactccgaaaaagtaaaatcaaacgaaataatcctcaaatatttcgaatccggccatacctttatggcagctgacagctttcacgctgccgtagaaaaaggtatgcgccatggatcgccagcgtttccagaattcaaagacgtagtccagaaagcgaagaagaatgttattgcgatggacatggcagctactgatttcttcgagttgagaatgacggtgtctcaatacctattgaaccagtgtaagcctcgaccgtatattgaaaatataaggaagatcaaattaaaaaaaggcagctacgagatgagctacagtggctcattggatgatgatgtcgagtcgacatcttgctgtattttttccaagaagcagatgaagacggtaaccgatgatagttttgagttggaaagcatcctatcgcgtcgaaaagttcctgttggaatatgccccacccgcaagcaagcgcttctcagggtaattttaccagtcatcgaagaacaccaaaagaagttttggatcgatattccagaacgccaggaaacataaatcgaagcataaaaattcttcgaagcagacgggaagtgattaatctttaattattttttgtttcatattatcgaacatgctgttattagaattaaaaataaacactcatgaatttctaaaatatatctgaaacaacgcattgtcgcattatcttattatcgtaatcatatggcatttgaaaaaaaaatattccgtatcatttcgtttatattcagtgaatcactaacaatgtgactgttatgcgattatttgcaatatgggacaacaccattggggtttgtttttgtacaagtcaggaacaaagactactattttatcattttttcttgagcgtctaacgatgttaagttgatttatgcaaaaaacgcaaattggtcaaaagtcaacatgggactgttatgcgaatatgggcagtgttgcgatccatgatgtactcacatctaaccggattcaggatatttctctcgcattacacgtcgaacgattgtgatctcgtttccatcactagctctcgcaggagaaatgaatacaatcaagtgaccatcactactcactacatcactattgaaggcttcttaaagaacgatggataaatatcattcacaagccaatcacaactggtatggcaatgagactgacttacctgcgaggaaagaatcaagcgtccaatttatagcaccagaaaaataaacgtataatacaaaaaatcagtgttaagtctgactgaaccatgtgctttttagtggtctcaggaaaacgtactccaaccaaacgaaataacaaaatatttgcatcatttgcagtaatattgaatcttatctctttgttaaaacatctgtattaaaatatcttttgaaaatcagaactgatagagttattgacttttttttcgaagccaaaatatcatctagtccggtctgtctgaacatcgaccaaatggaaacaaaacaataagaaaatcaaaaaaaattgaccatgatcggttggtcactcactggtggtaaacaaaggatcaaaatttctgcgcgcgcggagatttgtgctcttaaaaatcgagttttgacgtcgatgtgtcttgaacttaaattaaaaacaatctttgagcatatttgttgggcttctcatgggttttgcccgacaagcatttgaataagatcaatcgatgtcaaactgacgtctgtcggttttgcgactattattattattgttaggacttgtatcatttttggacacttagccgaaattttacacattgaacaacggttctttctagttctatttcgattttctcctaatataccgtaaagtgccctaattcagcgcattgcctaattccgcgcatttcatacaaaattatgaatatatggaaatacagattaatattgcagcaaacttttcatgccatttgatgcttctttcttctagaataagtttgaatcacaaagaaaagcaaataagacactttttcacggtataaaaaaataatcagtggaggccctctaaggctaagtagcccgtcattccttttggcatcaatgatgacttttcagctttcaattcaaagtgataaaactcagtcttgatggtttatatcgacttgaaaatatatcactgtacgcgctaacatgcataaaatatgctgatactttttcagctgtgtcagtgcaaaaccaactgactttctttgattcgaaatcgtgagagaaattagcaccaatcatcaacgacgcgtacaaatttcaatgacggactacttcgccctaagtaaacgcaaattttctaatttctttagcgtccatgctaagactgtaggacaaaaacaaaagcaatttctataataaaattgctttatttgttatgcaatattccattaaactacttgctacagatatgcttctatgaaatcttatcaaatattagcataaatattgagttttatccaaaaacgtattgcgcggaattaggtcacggcttttttcataatgccctaattccgcgcactgttctttactgaacaacaacaagttaaacatgttatattcgtcttcacatctgactatttctctgaaaagtatcttcatgcatagatacagtatggcccataaaaaaatgcgaaaattgtttgaacgtgaatatccctccccttggttatgcgactttgccgcgattggagggcataatccattagcccatatgatggaaaccaaaggcgtaacctgtagtggtggtatcacattttggcatttttttttttgcttaaagccgcgtcataattcatatggtatagacgcactaatatctcggatgtgatccaacggacattctgcgtcattgatagaattgatgcccatttcaaataatgaatctattcgaagagggacattaatactattggtgacgatcagtttgccttttggtaaccagaatgatccgtagccactcttactattagctagctagacacatcgttatcatgtacaacgtaggaaatattactctgaggaaaatgactagtagtttcactgagtagaaataagtggcgacaattttatttcaatatggtttttacattgccataaaaagaaataacaacggtataaataatctaatgtcagcttcattttctcaaaatttacaagtagaaagtaggcgttgtgaagcattgcatttgccatagaaaagtgaatcttgtaggagactgtaatggaagcctttaggcggatcatcccatatgggaagaaactaaattttcaaaaaattaccaagaactcaaaaatgcttacttgaggttaacattttgtacagcttatattgcatactagtggtcccggcaaacttcgtcttgccatcaagtaggctgttgaaaaatgtcatggaacctctcacacaacatgatatattagtactcccccgttataccaaactttcccacaacttccctaaactttttcgtcacacgaacacgtcggagcccttcaagaagacaacagtgaaagaattgtgcaaatcgggtgtcccgttctgaagttatttcgtgacatacaaacaccactccatttttatttatatagatagaagattggttgaatagtcagaaaataattctgatagaaatttcattgctactacattttaaagctcttgtataagctctatgtgactgttatgcgattacaattgccaatgtgacaaaacaacttggtatttttttttcgaattttctagaacaatcacacagatttcagtaagttgatcgaaagtatttatgatttgatgactgttcccggtattaacttgaaatttttaaaaatgtcgaatgtgacaaatatgccgttatggccagaatatgtatcaacaaatatggataaaatggcagtgagcgaaactaggagcgtgcgcgaaatattgtatcatcacggtattgttaaacacataaagtttgaattctgtcggaaattatgcaaatagattgccatacaagctggaaaacttgcatgcaagctggttgaaatattcaaactatgcatttccaacacagccaatatgctatgatatttttgaaaacggcaatggattcagcaactcttaattgagtaaatagcggtattttggtgcttgagacaaacatatgttccgcagtgttatttaattatttaaatacagttttcacaaaacatctaactattttgaatttgttcaaatgtcttcacaaattaagagatgtcttccaaaaatgttactatgtaatctaaaaaacttttctcattctaggtgaaggccatctacgtggccctgatgatccgtcgcgtcatggccgccgaggtggacaaatcggccgtcgacgatcgcgattactacggcaacaaacggctggaattggccggttcgctgctttcgctgatgttcgaggatctgttcaagcgcttcaactgggaactgaagatgatcgccgacaagaacattcccaagataaaggcggcccagttcgacgtggtgaagcacatgcgagcggcgttgatctccaccggtctggaaacggccatttcgacggggaactggacgatcaagcgtttcaagatggaacgtgccggagtgacgcaggtgctttcgaggttgagctacatatcggcgcttggtatgatgaccagggttaactctcagttcgagaagacgcggaaggtttctgggccgcgctcgctgcagccaagtcaatggggaatgctttgtccgtcggatacacccgaaggagaggcttgcgggttggtgaagaatctggcgttgatgacccacattacgacggaggtggatgaagagccggtgatccgcttagcttataattccggggtggaggacatccgtttgcttgggggagagaccatcaataatccgaaggttttcatggtgtttatcaatggtaacatcttgggagttacgatcgggtataagcgactggttgaggtgttccgtatgatgagaaggaagggtctgattggatcgttcgtgtcgattcacacatcgtttacgcagcgttgtgtgtatattcacacggatggaggtcgtctatgtcggccttacataattgtacagaatggaaggcctttggtccaacaggagcacatcgagcagctgaaaatcggattgcggaagtttgacgacttccttcacgatggtttgatcgaatatctagatgtgaatgaggaaaacgattctttcattgcgtatcaggaagttgatattgacccagagaagacgacgcatttggaggtggaaccattcactctgctgggagtttgtgcaggtttggttccgtatccccatcacaatcagagtcctcgaaacacctatcaatgcgctatgggtaaacaagctatgggaatcattggctataatcagaagaatcgtatcgacacgctgatgtacaacattgtctatccccaaacaccaatggtacgttccagaacaatcgagctgaccaacttcgacaagcttccggccggacaaaacgccactgtagccgttatgagctattccgggtacgatatagaagatgcgctgattctgaacaaagcttccatcgatcgcggttacggtcgttgtctggtttacaagaacagcaaatgtaccatcaaacgttacagcaatcaaacgttcgatcgtatcatgggtcccatgaaagattcgctcaccaacaagatcatcttcaagcacgaatgcctcgatacggatggcatcatttctcccggtgagaaagtcctttccaagcaaaccatggtcaacaaggagatgcccgcagtcaaatcgacaaaccccatcgagcaaaaagaagcaggacagcaaccgatcacctacagccctgtcccaatcacctacaaaggaaccgaacccagctacatcgaaaaggtcatggtttccaccaacaacgaagaggagttcctcgtcaagattcttctccgtcaaactcgtcgcccggagatcggcgacaaattcagctcccgtcacggtcagaaaggtgtaaccggactgatagtcgagcaggaagatctcccattcaatgacttcggaatgtcgccggatatggtcatgaacccacacggtttcccctctcgtatgacggtcggcaaaacgctggaacttctcggcagcaaggcaggagtcctggaaggcaaattccactacggaaccgctttcggtggatccaagtgccaggacctgcaggatgaactcttcaagaacgggtttaacttcctcggcaaagatatcttctattcgggcattaccggcgaaccgctggagatgtacatctattccggtcctgtctactaccagaagctgaagcacatggtccaggataagatgcatgctcgagctcgtggtcctcgtgccgtactcacacgtcaaccgacgcagggtcgtagtcgagaaggtggtctccgtctcggagaaatggaacgggactgtttgatttcctacggggcttccatgctgatcatggaacggttgatgatttcctccgatgcgttcgatgtggacgtttgcaacgtgtgcggtcggctggcatactcgtcttggtgtcacaattgccggtcgtctgccagtgtgtcgaagatttccatgccctatgcttgtaagctgctgttccaagaactgaccagcatgaacatcgttccccgacttaagttgaagaactattaaggtaagcttttattattacactttccgttgattgctttgttcatttacgaaactaaaatgaatttatagattaaataactagttttttatttatccgaaacagtcagaaacacgggctacattgagtacttctgctcgattgcgtagaacccttctatggaatattttcttaggggaacttacgtattatcggccgatttgttctcttcgtcatggggggtttttatcgaccaaaacttctgaaattcggcagtaagatgcacttatatggtgaaagtattggtgcataatttgagcacaaatattttttagaaaaccacccaagacgaagagaacaatgctgccgaaaatacaacaagtcactctatataacttgctttcgaattgttgaaagaatgttttactggagtctggatttggatgaagtggaaaaatcgcggtgtcgatttttcatagcccgtagtgttttttttttcagtgttctacgttgctgctgctgctactgctaagcttatacaggacgaggtccttgacaggaggtgcacaccaaatttttaatgctgtaaaccagcaattttttgctgattttttttgtgctgtaaattcagcaatcgatccagcaaaacaaaatttactggatctttcagcaaatcaaattttcatcaaggtgacagctgg

SEQ ID NO: 181 - DNA, 17088 bp, Aedes aegypti
ttgttttaatttagggtctctagaatttgaagaatcccaactatgcgaaatccattacccacttgccccacggtaccttaaataattattttatcaaatgaaaataatgtcagacgacttcatttgaaagttgttaatattgcttgaatatatccgtgcttaaaatgttggtttttgatatgataaatcaaaacggaaattagggcatgagcggatactggtgcattgatggtactatgttaatggtacacgcagaaaaaaaaattttgatatcaaatatattctggatcattacaacaaattttctgtattatttggtggcttataatagcctttcattgtttcaacaactataaatgatttagtttaaaaatatttattgttgaatttgacagctgggtataacgcggttcaacaaaagaaatatttgattcaatgcgtttttcttttgagacaacaatttttttgcattaaaatgaaaatttactgttttatatcaaagcatagctgttttttgattttataatatatttatttgaaataataacatctttttattggccgcagtcccctctcttttcattttgtttttattttggaatgaagaaaaacgagtatggcttttaaacacttaatttatttacattttacattactgctgtaagtatctgggccactctccaaatgtataatcattggattcgtgctccgcaagcgacgggatgaaattagcagttcaacttccttttactaaattagtatcagcgtttcaatcttgtattccactgcaatcattaaacacatctaattagaataaatattaaagaaatagtcataacttaccgagaatagttttgatcgttgtttcatatgtttcaaaacaattgattgaaccttccctgaagaacgaataaatgtttccgcgccagacatttttacttttgtttagagtaaaaaacaaaatggcgggtcacttaacactccaacaatgaaattaattggaacaaataaatcttccagttgaaatgaaactaggttctgttgttttaaaaatatatctgattgagaatgctgtccataatttcaacaatattactgattcgttttgataaattcattgttgtttcaacacagtttattcaattacaacaaattgacagtgcttgttaaaaataacaaaaataatcattgttttaaatggctgttaattctctgcgtgtactaacagggctggtagcaagtcactttttagtgacttagtcattttttttcgaccttgtcattttttttcgaccttgtcacttaaaagtcactaaagtcacttttttcaagaaaatggtcacttaagtcactttttacgtgacctaatgataatggaatttaattttctgggctgggttagcttttcaaacacaaaccagagttgcttagtatcaatcatatcagctgatggctgatggtctaaaactatcaatatcacttgcgagctatcaatatcaccttgatttgacaaccaacagcattgatgcgacatcgcactctagatcaaaatcactgcagaatgagtgatcacgtgatcattatccatgctattaggggaaatcagggtaaaaccgacactgtgggtaagctcgacaccctttgatttatcatgttttgagcagattttcatgcagtttccactacgctatattttaacttgtgaaatgttgtgtttcaaatgacattacaactaacgctaccaataaactaccaaaataaacaacaaaatcatattggataacatagaagcaacagcagttgcaatatttcgctgttattctttaacaattccgcatgtgaaatttttaaaatatcattatttgttctgcgtctacatcatcatttactattattacgttgatacaacatgaaggagaaattaatttttagtttttcgacagctgaaaacgctattgaaaaataaatgtccactcggggtaagatagacactttcatttggggtaaaatcgatacctttctttgcttcatcatctaacttcagggaatctttctaatcggaagactatctctgcagtttatgtgagtcttaattttcgaattccagtgaagttcacggatggcgaacttgttaacatgtaaaatatgacactatatgacttgccacaagcaatcattaagtatttaaaaaaaaaatatttctatgctatcacgtttgaacttatttgatgaagcttgaagaaatttttctcatttaaaattgaagaatttgaattattttcacatagaatttgaaatattttcacataatttaatcttattgtttatttacaaactttggtgttcaacagtttttataaactgaaaataattacacttttctgttttgttaaaataaaacagtgtttatttttacaatcattcgctacaacttcatcttcataagcatttcatgaaaacaaattaaaaatatccatgtgtattcaccccaactatataatcttagcatgggacatttgcatttttcacatatatttagtggaactttggcctctcctcaataatttacgtaatatgttaataatcctttaaaagaagggttcataaatgtcgaaagtcatgtttaaagcattcttttaaatatgcaatgtgatcgtgatgttcacaacgtatgaattctactcaaagtggatgtgtcggttttaccccaacagggtgtcgattttacccggactctcaattggctcacctaaaaatgatgaaatttcaatttgatttaaatcactatataaccttaatatatcatccagcgatcgcaaggattgatagatttataaccaatttgtgattctacaacaattttaggttcgtttaacaagcgaaagtacacacattttatcaataagcttagggtgtcggttttaccccgaattcccctaatgtttttcagtgaccaacacatagtttcaatctatctgcaacactgtcgaaactatcgtactgataaattgccattttatctgcttaatttaaagctatagtctatcgccatcaatgcacttgtgatggagtagacagcatgatgttgatgtgatatagaatgatccgatttgtatcgcagtcggcctgtacaaatcagcaaattttaaggtgattatgaaacgaagccacaccacaaattttcaacagcacaagacttaagaaccaaataacgctctgtgttgaaaatttatcccattggtcaccaccagcaagcaagcaatttgattgattttttatctcgaactgttgtcagtttctctagtcttgtgcactcgaaaattcaaagtttggcttcgttttataatcaccttgagcattgatagcgacatcgagcaactctgacacaaacagaaagaaatatatatttgttatcatataagtagacaactatactgcccataaacgcatgtcagtcccatgtttgctggatttcctattcacatgggacaattatgcgtttatgggcagtatagtgtgatttggtaatcaaagcgtcaagattcttaactcaagaaaaataggaaatcccggctaactttctggatgaattcaagtcaatattccgtagacattctgggaaaagttttggagaagattctggcaaaacttagaaagcaacttttggatgtaatttttgtccgaaatatttcataaacttttgccaaatccacgaccaatatctgatctgagctttagaagaaatcatagaccagctttctggaaaagcattctaaaaaatctcccccgaagataagccagagacggctaggaattattgcgtttcttttgcaatttttccgttctgcgttagccgccaagttctaccgcagacttgagaatgattgtatcattgtacgaaaccatctaatcaaagtatgctagtagagtccacagctttgaaaaacagccgaaaacaactatcatcagtatggttttcaaggtatcatagcagctgatcaattatgctttgtgaaaatcagtaatgtgacagctgcggtagctttctgttcaaccgcagaacggaaagttatctctaaaattgcaatacatccaaaaaaatttgattttgtcagaaactcgtccaggacttcaatagctagtacttattttgctggaaatcatttcggaaattacatttgaaattccaacaaataaacaatacatttttccaaccattaacccttgaccttgacactgtttttttacacgactcaactacaactatttctttacaaaaacacgtttctataatgaattgttgaacattgtttgggataataattaatcaatagtgatatcagtggcgattacctaacgtcaaatcaacctgttcattaatttcagcaacaaatatacgattcccatcggctattgcttgctttataatcaaagtatgcaacattagtaattttttcgtcgtaaatcaaataaaacatgaggttaagagtcgtcactgagtgatgatcattttctgtaattcattcattgatacgttcagttgaaatatagatatttgaagtacgcgtggaatcatattctaattctttatgcacaattttgtctacaaccaaccatttttcctcgatttattccacagattagttaacaaatgcttcaagtaattcgttttacatctttacttcaaaatttacaatgaattttcaccagaatgttcctcatgaacaggaattttgctaaaaattctatcacgagttcgttcaccagagttcatgtaggtatttaattttttgttttgttttcggacggaaatcataaaactcttctatgttcagaattttgaagatattccgaggttccttgggggaccgacattccctcatataaaatatctttggccaccattttgtttttagccaataaatcaaaaaaaaaaaaaaatatgggctgtgcaatgttagacaatgaggagttacactgaaaaaaaaatcatgtaaatcgattgaatcgtctccaagaaaacttaaaattagaatatgtttttttcttttaagttttctagatcctccttcggcctgagtggtatcacaagcataaatgctcatatctcaaaaacagttgaaccaaatcgtgttattttttcataacagactctcatcaaagtgtttcgaaaaatgaacaaccaaacacgagaaaaaaatctgttgccttaaatatgaatgtgggctatggctacgtgttggtactccaaggaatttggaaatatctccagtttcagacgaccaatgaataaaatcgacgcatattataaaaatagaaatgttttttgagaatttgcgaaaaaatagtgcaaaaatatttaaaaacaaaacacttatcgcgatgtgaatattttttgttgtaaaaaactaatggtgttagtattcatttttatgactaacacttgtagttttcaagtcactttttggtcactatttggtcacttttctgattattttacgcaacactttatcccacgctacacattgttggtggacgatgaaacccaacgtgtgcactttcatcggtaaacgggctgcccggtatcgtacacgcaatgctgccaatgtggtagagagctttttgtgttggagagcaggtacatcacacaccctgtagtggagatgtcttgggtaagaattgtagaggtagtatttaaagtgaatgaattgtaaatatctttacccagacatgaaataaaagagaggtgctgacgtggtagtaatatcagtccgtagcctgcggtgtggagcgaatagccttgttttgtcgttttatttcaaaaggttatgggcccaggaacgcctggaggatgctgaggcagcttcaatgagggaccacgaggaagcacctggacgaggagacatggcctagacgaggaggtagaatctcggtgaggaggtagaatctcggtgaggaggtagagcctggacggaaggtggggtctggacgggaggtggcttggacgaggtgcccaagagttggaggccaagatgctgagaacgaggctgatggtgcggatgctggctgatcggacgacgagcttggaacagctggaggaactctgaagtcaagaggagcttgaaggacggcgcggttgaccaaaaggacgatggtgcagctggccaggataagctcgactaggaggagttcggtagctggagcttggtgccaggagaagcttagtggacaagtaagctcgggtggcagatggcggtttgaaggttgtgtgatgaggaggagtgttggagagcaggtacatcacacaccctgtagtggagatgtcgatgggtaagaattgtagaggtagtactttaagtgaatgaattgtagatatctttacccagacatgaaataaaagagaggtgctgacgtggtagcaatatcagtcagtagcctgcggtatggaggaatagccttgttgttttgcgtcgtttcatttcaacattttgaactacaaatgccagtgtgtgagtagccaaagcgttaactccgaccagtgcacatcttgttacagcaaccaagtcgaccagtgtgagagtgcagatgggcatgaaaagagagaaatcaatccacgagagagattcattttgcttgctctcttttggaattcgcgccgtcagcaatcagcatcaccattttttttttcccctcatctgtagagccttttaaccactgcttccattatttaggaatattgtggtatgacccatattttatttggtgctcatcaaatatcctttcacaattgagatgtgatagacattggttgatgtgtcacactgtcccaactgggcacaactcgttttataaagtctattaccctattaggactaccttgccaaatttccaagggctctaataacccttttccaaatgttaacgttctttgattaagcaatgctccgcagttgcagagtaaatgctcagcagtttcgtcttcagcttgacaaaaacgacactcagaggattgtatttttcctatatttttaagatgatacctacttgggcagtgaccggtcatcaggccagttattaccctaagatttcctttattaagattcagtatagcccgggctttagctagactgggttttatgaatcttttcgcttgcttggatgtatccgtggcgttccaattggattctaccatggacatttcccatgcttgtggtgtgatcaaacctcgcttttcgcatcctgcgcagtagtttttgcaataattaatcgcagaatggccgcgcccacccccagcgccatcgtcgtcaccacgcttgttctacatgtaacaaaagcgagtattttacacgatgcaaactattttggttcaattctatgtaaagatatacatgaccgtggtgaccatagatagtcacagttttaaattgcaagattagtttgaaaccagtgctgttgaaattgtcactacttcttcagaattcatcattgaatgatgactgattattgggttattttgcgatgacaaatttaccggtttttattggctgcttaacaagaaacttgtgacgactgacgagcccccattatgtatataacggtgggtttagagctaagttggaggtgatgatttcgcattttggaagaaaacatcaacttcaaacactaacgattttgcggtgggatgttgacgtttgatcacgaataaatggatcattgaaggtaactctttcggtactcaccgcatcaaaacagcggcgctaccatatatggaatttaacattgtgacagcatcgctgttatgtcaaacacacaagactacggtggcgttatctgtgcttttcatagcggccgttttggttattttaatgatccattgaccgaaaacgcacttttttcttgttttgaacgatattattacgctcgacatcttatttttgatattctgaatgatcaaaatagatttcaagctcaaattttaggctcaatgacatcttatcccgacagtgcgtcctgtattaaaattttccaaggggaattaacagtttcagggcacggaaaattttgaaacaggattctagttcaatttttaacgaagatttagaatatatatattggatacccatatacaactctattgataaattcaactaaagagcttgattactaaataaaatataaaatatttaattcgattaaaaagctgagaaaaacacatattcgagaatggtgattacgctcttaatactaaaaaacttggtccgtggagcatacatattgcaaaaaaaagagaaaaagttaagtaagcagtgcacaggtggataataaggtcacgcgacggctcttggaatcaacttctaagattacactaaaactttaaaggcacaaatctcgcgaagaaagcatcccacaacagtgcactttttattttggttttgtgcactagcagaaagcttaaaataagaagatcaggaacgtttgccaactatttcaccagttttgtacctttgaaaacgtgagtagggtggtaagtcggccattgtgtcggccatctttggattccgagatgtttcaccttaagtagttgttcaatcaatcattcttctgtattcgccagctttcacaaggacgtgacagctctcgactgttagaggatgcgtcaatcttgtcttagagttagaggttaatctcaaatttttgactctggtaacggccgtccgaaggaggcaaccctcatataatggtctaggactgtaccatctacgaatttgtgcgaaatgcttaatgctaatttgatatgagatagcatattttcctaatgcattaggaatattagaaggattccagaagcaatgcccggaggaatttttagtagaatttgtgaaagaaatatacggagaaatcattcgataaatccctttaaacattcagaaacagttctcgaacgaatttccttggattcagcaacttttccatatcgggtagaattcctgaacaaatcacgaatacacgaacatatgcataaagattacatgtccaatttcctggaaagaaaatcctcgagaaactcctatattttttgtggtcgtatgaaatttatgtaggagctattttaagaaatctaaagacataatctgtagaaatataagaaagagttcatgctacatcttcgagaatctatgtcaggatctttggaagaaccaatagaataatttacaataagtggcaaaattattggatgactgttgaacaactaatagcacaaccaggaattggctctggggaaggagtttgtttgtttggtggatgtaagctggatggtgatgcttttaggaaaagtatttttagtgttataaacgggataacaatgatcagaattacgcttctctcaaaatgtttgattcaacatgtttcttgaaatatttttgatgcatgaatgtgcttcttttacttgtattaatggacttcttaaaaataaggttttcactaaaattaaattttgttcaaacgtacagttttcatcttttcaaaacaatgatttccatgattatggatgacactaccgaggattcatgccttcatgggtcgcgggttcgaatcccactggtcgaggatcatttcagattgaaaattatgtcgacttcccagactttcctcgtggaaaaacagaaaaaattgtcctaaatccacatgttatcttgaaatttagtgaaaattgtctgatcgtgcgaaaaagcaaccaaaatttcacgtttttccttagttttgtgaaaaaactgctgttttttggtatattgaccctaatttgggtgatttgttgataataataatagtgtattctgcaaacataagtttatggctggtataaggtatgtctttcataaaaaagatcgacacactagattcgaactcttgccccaccgggttcgtttaagacaaccaattttaaaacagttatgactgacaatgggtaaatattttcacacaagtttgtaaaacaaaattatagccaatatgttgaaggtttacgagtacgtttgatcgcgattactgtgtaaaattaaattgacaaaaagtagagctagcaaagaatattgtatgcctgcatgcgcctcaaagggccagcaaagttttggtttggtggatgtaagcaagagcttcgcacttgggaactcttcagatttaggttattggaaaatttccccactgtcgttgacacggctggaattcacaaaaaacttctcaatttgaaacgtaagccagaccaatcaatgggaccgtaacgaaaagcggaaacacacaaggctgaaactcaaaaggcagacgttcttagaagagtaacgaaaggcaggaagtaccataatgcataatataaaaaggcggaatcagtgaaaactctattcaagactcaaatgtatatttatatcaaagtttatttattagttcagttttacatgtttttgtacattgaatccagcctcctgacaccgcccatacaaccccattgaaaaataacgagcaaacatctctggttcctaatgggaaatggttcccactgacagcttaatgtttgtaaacaaatgaccgtttgaggaataataatcgatgatggcgaaatctttttctccgaaatttttttttcccgcataacaacagttattcgaacaaacaaacgcttgcaaactattggattgcagtacagcaagtcaatttgggttgaagtgataagctagaaacacattttagtattagaggaaaatatccttaatatgattaggccattgtacgttgttgctcttgagtttgatgctgaccacgaaaacatggctgcctagcaccgggttgattgaatcatttctgtttcgctttgtttttgcagctagacaaagtctagctagtctagtctagtgatcctttataagagagattcgcggaagctgacacttctgtcaaagtgtgagccaatcgagcagcgagagctgtcaaagcgtgagccaaacgaacatgcgttatgtttgttttgagcttttcttgaggaataatgtaatccgattgaaattatttcagtaaaagttgttttgtatagagcaaaaatatgaaataggagcggaattaaaaggtacacggtactccatctacttttaagtttctctatatgagattctgctcagaggattcgaacattcattaaagagatgaaatattttccttttttgaatttgtgtcaatgctatatttagttgttgattttttctgctgtgtattagtttgcaaatgtagctcaaagatctataacgaaacaaaacatactttttagccatgaggaagtcatgtcggtgttacaatattattctcgatgccgagcaaactcagcactgctagtctgttgccaaatctttccattctacttccgcgtatctctcatataaaggatcactagtctagtctagtctagtctagtcatttcttctaaaaaatccctgttgttgacaacagcagcactgaaacatagcttgaatatgtttcgattcatttcggcgttgtcagcatctccaagcggacccagatccccttcaagaagcatagaattttgctttctgttccatgctgttcctttctcaactcgtctactagcctatgcataccaaggtgattgtttcctaccaacgtagactaccttgtatgccacgcttctagcaaaattgtggacttcgaaataccttccattattcaccctcattcttatttacggcggattcaactttcgatcgaatcctattcgttcgaattcatagcccatttgattttgctgacgtaaacgggaatgcgaaacggttttcgatcgaatgagcattcgaacgtaaacaagaataggggtgattggttcgaagttgcttggatgaaatagtggccgtccgttcccatttctaccgttacgtcttcgctccaaatagttgataaattttgtcaattttattggcaaagctagttcttcgtaggcatctgttatccgttcagccggcaggaaagtgagagcttgtagtttttttattgctaaaaacaaaatttgagtaatcattcctcacgaatgagacaatttctaaaattttgggaaaaatactcaaaagccaattcaggcattggaagagaaaaacaaattattactaactaatggatcattgaaggttgtttttgcaagtgctcaccgcatcaaaacaaaggcgccactgtatatgggatttaacattgtgacagcattgctgttgtgtcaaacacacaaggctacggtggcgctatctatgctttccatagcggccgttttggttattttaatgatccatttggaactcactagtcaaacaagagaacgttttcggtagttcctatataggaaaaattgaaaaagaaaacaaaaatatgaaaggccctggcgatgatgtcttgctgtgtgcatttgaaatgcaaatatcaaatgcgggaacaccaaatgcggtaagatttttaacaaggaaggcgaagtcaaagattgattttctttgctaggttggcggtgatatggatcatggttgcttagtatcctttgaataatttgattttccgcattataagccctgtctgaccagatttgcacttcaaacgcaaacagcaataatttttttgcaatttctcatcgtaataggctgattttcatcacgccaatctgtcatgaaacggcctactttcctgcactgaagtatgcagtgcgggaatagtcattacgcaactgcaaccagtggtgtaatgattcattacgcaatgctttctcattacgcaactgttttgagttttgagataattacgacgagtaattatcgtaaacttgtcgcgtaaactactattacattacaacttccagagagtagcttatcattgacatatttaacaaatgttttcagttggcatattttactcaatagaaaaagcaattcgacagtgtgtggtatgaaggcttgaatgtaaaattaaaaatctttacttttctatatacattgttacaataattttttgacagataactttagatacacttaatttacagaacaacaagcctgagagacttccagtagaagctagtgttcctcaaggcagcattctgggaccaatattgtaaaatattttcacatctgaagttacctcagggatgtcagaaattgttatttgcggatgccacaggcctctccgccaaaggacattcatctttgcaaaaatttgaaaatttctcatattgcttgccaaaaattaacttattatatttccacataaaccaaaagcactttatttgatacccccaagtatgttgtcacgatgaaaggggctccagtaaattggtcagatgaagttgagtatctacataaggctataaaataaaaatagatataaatagataaataaatagataaaaatttaattttaaaaaatcgcatttagggagttcaagccaaatgtatcaaatatataaaatgtctgtatccacttattaacagaaaatcgtagctttgtccttaaaacaagcctttaatcatcgaacaaattttcaggccttacatgttgtattttataccaatgtggtctagctgttgtaacaaattgtatattgtaaataaatcaataaataagttacgagttacatagaatatccaatgttgaaatatttaaacaaatgttgaataaaatttgtaataattttagattaaaaacgtagcaatcttttattgcctcgattgatgcgctatacattttggttaaattaggttaagttaattgaaaacatttttttttctcttataagcaggtaaaatcaactcacatttaaaaattctgaactactacggcaaaaaaaactgtaaaatgttgttaacataatgttaataatagcttagttttaacaaattaggatgatagtgttaccttacacagaaaacctttgaatgtaatgtttgaaatggtactaatactggaattgactaaaaaaaagttctattcgatctctactctcttagtactaagcagctgaataacgtttctcatggtaatcttattttcagatacgaagtgcagaaccagtacaaagccttctacacgggcggtacggttcaatggacatcggatggaagcgaaatgctgtgccaaaatgctggcgctatcaacctggtgtcggtcacggatgataccgttgaaccggtcatttttggcgacgccgatgaatcggacgccgtttacacgtttgcgctgagcaaagatagtcacaatgtggtttcggctcaccggtccgggttgatgaagctctgggacaagaactccaggcaggtgagcaaaatgtggcgcggacttcatcagggccccattacgaagctggtcttcagtgacgatgatacgttgattgcgagtggaggcacggacacgacggttcgcgtttgggaccccaaggaacaagtttgtaaggggacattgagaggatgtcagggagtcattaatctattggtgtttcatccggacgtggagagcaagatcctgctggctgccggtgatgatgtgaagatcaatgcttggaactatgaaacgcgagagttggtaaaatctttcgctggtcacttttcgaaagtaacaggcgtttcgtttacaagcgatcacaagttcttagtttcctcaggtcgcgacaagattttgattatgtggaattacgaaacacaacaagcggtcaaaactattccggtgtatgagagtttggagagtgttattgtccttcccaaaggtgtccatcttccaggtttgaaactgaaatcagacaaagtgtacgctgcatgtgccggcgaggaaggattgattaaggtatgggaaatgaccgaaacgaagattgtcttcaaacagaagaacagcttggtcacaaaatctgcagaagagggtggtctagccataacggatttgctgtttaacaaacaatcttccaaattggcgattgttagtgctgatcataacatcataattcacgatctagaaacattcgaatgttctaagcaattatctggcttcagcgatgagattttggatcttattctatttggcaagaaagatcattttctaggaatggccacaaacagtaacgatttcaaaatctatgataccacaaacatgaactgccagttggtcaaaggccacaccgacatcgttctgtcgctatcggccaatcaaaactatattctctcgtcatccaaggataattccattcgattgtggcgttatgatacggccaagttcactgttcagtgcgtagctatcggtcttaaacataccaatgccgtgggaagcatcgctataagtaaagtatctgggaaattctgcgccagtgttagccaggacaaatgcttgaaagtttggaagataccaaaagagttcaatgaaacaacggacgagaaggaactcactcggttgaactgcaccctaaccgaattagcacacgaaaaagatatcaattgcgtgtgcatatcgccgaatgatcgactgattgcaacgggatctcaggataaaacggccaagctatgggatgcaagtaatctcagtttggttggagtcttccggggtcaccgcagaggaatctgggctgttcggttctctcctgtagatcaaatcttgctcacaaatgctgccgattgttccatcaagctttggtcactcaccgatatgacctgcctcaaatcactagaagggcacgaaagttcagtgctacgagtagaatttctgtcccatgggatgcaattgctttctgccggagcggatggacttttgaaactgtggtccatcaaaacctccgaatgccttcagacactggacaagcacgaaagccgtatctgggctttgtgcgtaactgaagacgaatccgttttctacagcggtggatcggattctcagctgatcaaatggaaggacgttaccgacgagaaacgagaacgggagatgaacgaacgcaaggaggttcttcttcaagaacaagaactgaacaaccttcttcaggacaagaaactgctcaaagcactccgcctggccctcaatctcgatcgcccactgatgacattgaaaatcatcacctcggtaatcaaaagtcaagaacagggtctcccggacaccatccagaagctaaggaatgatcacaaggaaaccctcctgaagcacgccatagaatggaacaccaacagcaaaaactgtcgacccgcgcaactagtactgaacatcctgcttcagcagatgctctccggggaattccaggtgtccgagctcaacaaacacctagaggcggccttaccctacaccgagcggcacttcaaacggatgaccgagtacgccaaggacctcaagtttatcgagtacacattgcactgtatgcaaccacacgctacgacacgtgaagccaataaaaccgacaaggtgtaacgctgcagttccagccttcagtagagtaaattttgtccccgttatttaatccgaatgccgttaaatgaaattcctttgcggatgctgtgtgtgataatggattagtaagtgtacataccatctttgaagtcgcattcgcttgttgacatgaatcagagcgtttttaaaaccgcacatggcggtatactcttatcgccaagtcattaccaatgaagcgagatcgccgctcattttgtgtacttattcagccaacgattgggattgtttgttgtttatcggtttcacgtttgtaactaattaactattgattcttgtgctgctgcacgggcgcccatagccaagggaagcgattttcgcggtcacaaaaaataagtcgtaaatgaatggaataggcattgcatatttttcaatgaacactgttcagacgatataagaggaacactaaatcagttcaagttcgttctcgatgtatagggtaaacaattactggaaacttccatgatccactttggcatgttttttttctcggccgaattatcttaaagtttgcaataagaaacatttcaatgcgacgtacattgtggctaaatatatattcataactgaagtgaatcaaaagtgccaaga

SEQ ID NO: 182 - DNA, 3168 bp, Aedes aegypti
ttgaagaggcagtcgatgagaagatcaaatggctagattcgaaccagaacgctgatacggaggaactcaaaaaccagcgcaaggaactcgaagaaatcgttcagccgatcatcgctaatttgtacgccagcggtgagagctcacctcagccggaaactgacggcgacgacgacgatcctttcaatgatgagctgtaatcgaagcatttcaaagtcactctagtttacgaatggaatattgttgctgtttgcgaagaataatagtataagaaaaatggaacaatgaagattattttcgtaagtcgcatgccgtgtgttacaaaaaagtttgaagcaaacacaaaacatcaaatccgacagattagctcaaaactcagaagaattcaatttggtcaacaaaagtttcttgaaagaattaggctgaattaggaaatcattacgtttaaaattatcaatcagacacatgcaaaaacgatttaaataccatccaactagtatgtttataacataggttcatatttcttgctttctaacaaaccatcaatttgtatgatcaaacgactaatttctgtctttcctttaccattgcagagtcgtcaaaatgaagctgctagtaccgttggccctggtggccgccgtggccgtactaacctgtaccgccgaggaaaagaaggagcaagactacggaaccgtcgtcggtatcgatctgggaacgacctactcgtgtgtgggagtgtacaagaacggccgagtggagatcatcgccaacgaccagggtaaccgaattacgccatcgtacgtggccttcaccgccgacggcgaacgattgatcggagatgccgccaagaatcagctgaccaccaatccggaaaacaccgtcttcgacgccaagcgtctgatcggacgtgagttcaccgactccactgtccagcacgatgccaagttgcttccattcaaggtcatcgaaaagaactccaagccacatatcaaggtttcgaccagccagggcgataaggtgttcgctccggaggaaatctccgctatggtcctgggcaagatgaaggaaaccgctgaagcataccttggcaagaaggtaacccacgctgtcgttactgtcccagcttacttcaacgatgcccagcgtcaggccaccaaggatgccggagttatcgccggtcttaacgtgatgcgtatcatcaacgaaccgactgccgccgctattgcctatggtttggacaagaaggacggcgagaagaacgttctggtgttcgatttgggaggtggtaccttcgatgtttctctgctgaccattgataacggtgtcttcgaggtcgttgctaccaacggtgacactcacttgggaggtgaagatttcgatcagcgcgtaatggaccacttcatcaagttgtacaagaagaagaagggcaaggatatccgcaaggacaaccgcgctgtacagaaacttcgtcgtgaagtcgagaaggccaagcgtgctctgtcgtccagccaccaggttcgcattgaaattgaatcattctacgagggtgatgacttcagcgagactctgacccgtgccaagttcgaagaattgaacatggatctgttccgctcgacgatgaaaccagtccagaaggtcttggaagatgctgatatgaacaagaaggatgtcgatgaaatcgttctggtcggaggatctactcgtattccaaaggtccagcaattggtcaaggagttcttcaatggtaaggaaccatcccgtggtatcaaccccgatgaagctgttgcctatggtgccgctgtccaggctggtgtcctctctggtgaacaagatactgaagccatcgttctgctcgacgttaatccattgaccatgggtattgaaaccgtcggaggtgtcatgaccaagctgatcccacgtaacaccgtcatcccaaccaagaagtctcagatcttctccactgcttccgacaatcagcacactgtcaccattcaagtctacgagggtgaacgtcccatgaccaaggacaaccatttgctcggaaaattcgatctgactggaatcccaccagcaccacgaggcatcccacaaattgaagtctcgttcgaaatcgatgccaacggtatcctgcaggtgtctgccgaagataagggaactggaaatcgcgaaaagattgtcatcaccaacgaccagaaccgtctgaccccagaagatatcgagcgaatgatcaaggatgctgagcgattcgccgatgacgacaagaaactgaaggaacgcgtcgaagctcgtaacgaattggaaagctatgcttacagtctgaagaaccagctcggagacaaggacaagttgggcgccaaggtagctgacgatgacaaggctacaatggaggaagccatcgacgagaagatcaaatggcttgacgaaaaccaagatgccgattcggaagactacaagaaacagaagaaagaacttgaagatgtcgtgcaaccaatcatcgccaagctatacgctagcactggcggatctcccccaccaactgccgacgacgaggatctcaaggacgaactgtaaactcttgtttgttagtctagcgtaattcccattttccgttccctggtcggtctagttagggcccttccaccactcgatccagtccggttagagctagtagagggactcggttcattactagccgtgtagatcaagtagaacaggaaaagagttccacagtagagcgtgtgcgagcgagagaatacaagatcgagtgttcgtgtactaggtacgcgttaggcgtgttctcatctcatttttcagatgagagaatgaaaattattgaaaacccacaaagtttaatttagagagaaacttgcgtgaatacacttacaaggcgataaggcatcttattcgtctttatttattgtttaatttgtttttcataaactgcgtttattattgccttttgatagggtagtctgagaaagaaaagaaactgctagttcatccccatttacacctcccatggtcatcgcagccccaccttagttggcacgaggacagcgttgacgatgggagtatactctattacccctccttagttcccagttattctaatattcctgtttggttcttttcctttctcaaccatcgactgattgtatgtaagtgtgcgtg

SEQ ID NO: 183 - DNA, 2637 bp, Aedes aegypti
cccgaaatgagcaatttcagcgttatgaaataaattaatgaaccctatgcaatttggcgaatctactcagcggtgcgacaattatgagcctgttcaaaaatttcataacgcttaatgggaagtatgcatcagtaaagtgaacgcctctctcgatgcgtggaaaatttctttcaagaaatgcttaagaaaagcatttttctttgatcgcagtacgcagttgaaaagaaatgtcaattcaaatggagctcactctagaaaatttcttgatcacttcttccgcagaattttttacttgttttgagcggaacagcggtgggttggtgtccttaaaatgttacagctcatacaaaatttataaaacattcacacaaaaagcgttacaaggggatgagtgggtatcaaaaatgcccatttttggcgttatgaaatttgtgaatgaatccctatgtaaattaaatggcagtttttaccgcacaaattttcatcaaataatttagaaccctattcatggatggattccgttcagaaacgagcgagaatcgaatcgtttttgctctgggcccatttattaccaacatgagaaaacgagaaatgctgtcacaccgatgacagtgcttatttcgctgaaaagttttgcaaacacggcagaggcacaagctgaaattgcagttatcaattttcggtaaaatcccaattcttatttctattgtgtgcaaaattgacatatttcatcaattttttctagataaataagttgcttaccacagtgtgaaaatgccgatcgaaaaccttgaggagcagggcttggagaagaacccaaaattggaactggcacaaatcaaatttttgctgagtcttccggaacataaccaggataaagccctatcggagaagctgatgacggctatcaaggcggacaatatggcatcctggtacgagattgtgtgcaaggatttgaactggatggtcgatcagaaactgctggccgatatgaaggaggtcaatcagaaaaagctacaggaattggatgacgtgattgacgatgcggagaaaaatcttggcgaaatggaagtaagagaggccaatttgaagaagtcggagtttttgtgccgcattggtgataaggagggagcgatttccgcttttcggaagacgtacgataagactgtttcgttgggacatcggctcgatattgtgttccacaacattcggattgggttgttctatttggaccacgatttgattacccggaacatcgaaaaggccaagaccctaattgaggaaggcggagattgggaccggcgcaatcggctcaaggtatatcaaggagcctattgtgtggcgattcgcgatttcaaggctgcctcaaacttctttctggatactgtaagcaccttcacaagctacgaattgatggattacgcgtcttttgttcgctacaccgtttatgtgagcatgataagccttcctcggaacgagcttcgcgacaaagtggtcaaaggctcagaaattcaggaagttttgcatcaactaccggatgttaaagattatctattttccctatacaattgtcattattcggatttcttcaaaaatctcgcacaagttgaatctttcctccggcaagatgttctgttccatcctcattaccgtttctacgttcgagagatgagaattcaggcctatactcagttgctggagtcgtaccgctccctcaccctgcagtacatggcggacgctttcggagtctctgtggattacatcgattccgaactgtccagattcattgccgctggtcgtctccattgcaaggtggatcgcgtgggaggaatcgtggaaaccaaccgtccggatagcaagaactggcagtatcaagccaccatcaaacagggagacatcctgctgaatcgtgtgcagaaactaagcagagtcatcaacatttagagttggctaccatacatacttagtaacagattgatttgcgtatgcttcacattcaacaacatttgaaataaatatcatgtatttgtcagaaaaggctttcatttgtagtgctgctagcaggtttcttcctatagacttggtcactatattaacgcatgtctatgatgtctgtgagatttttttagagaaacaatacaaaaatccatacgcctgtttttcgattaatattctttcagaattttccgagtgtttgatacgttgaacctattgtatgatcctttcgagcgagcatcagtatcgtgtccggtttgcgtagtaaccgcactatcagtgtcggtcattcatgtatatgctcacgtattcatttcgaattatatatttatcgtttaccaaaacgaatcctttcccatatccaaactcccagtgttctcttgtggaagtgcagaggactcctcggcttctgtaaagcaagtaacacgtcaacatttccctcccattcccaaattgacatgcattcggacgcagccggcgccggtattgtttattataataatgagagcaccagtacttacacattgaggatgctactgatcccgagtagtgtctgttggttccctgtgtaagtacagctgttcttgcaataacggagtacctagcaactgcgggcggtcaatcatgctcatgctcatattc

SEQ ID NO: 184 - DNA, 3546 bp, Aedes aegypti
accaacatcactggcaggtagaaaatgatccttttatcaccgtagcgttgttaaataacgtgtaaatccattcaagtgctcaggaacaacgagctacacacatggttaccaatggcttttagggcgttatcccagattcgcgactatgaaacaaaaagagatttacaaagcactcgcacttaaggaaaacctcgtaaggaactgtcatcgtgtgcgtgaaaaaaagcaaaaaatatatctctccttgtttttctcacagaaaaccgaggaaaacagcagcagcttcgtagtcccgaattatattttgaaatctcgcataacatatgatctcgccctaaaagccattggtaaacatgtgtgtagctcgttgttcctgagcacttgaatggatttacacgttatttaacaacgctacggtgataaaaggatcattttctacctgccagtgatgttggtttggatgattattcattcatttgctcagaaacaacgagatacgcacgtggttaccaatggcttttagggcgttatctcagagtacgcgagaaatgtttaaaatatttttcccgaaaaatattttaaacatttacataaattctacactaattaccatcgcagagcccctcgatgatgcaatcatctcttcgaagaaacaatgtaaaagtgaaacgggtcaaacgggaaacgaaacacccgaaaataggctgacgtttcttcaaactgtcatcagacgtggtcctcgtcgcatcgttctctctgcgagtcgtcttcgtgttttgcttctggtgcattttcgctagttttttatctctttagctgatctgtcgtagtttttcgaatctttcctatccgcatcccctatcccgccgatatcatggacggatcaaacggaaactccgttcccaagaggagcccggccccggagggagatttggaccagactccgatctttctagcggtactcgttgtgctcattactctcggtaagtattaccccaaactttcgccacttatgggccagaggctcccaaccggttttatatttgccacccactatgatactgatcgttgtggcatataactagctactgctatatcttgtatctatctagggtaaaagattttggttgaacaacttctgaggatttccacgcatagtcgaaatacggcgcgatttattggcatgagcgtgagatttaaacatattatccttgacttgtttaagtgtaaattataattataattataattgcaggaaagatttctcgcgtaacattactaaaggacctatctaacattgagaggctctctttgtttactttctctttcattaataactgagtcacattaatctcttctgttgctttttttgtatgaaacgctagtcaaggaaattgactttcgatctatagtgaaaaacttcccaaaatctttagtattccactgttataatcaaaagagaacgagagaggagagaatctctcatttgtacataggtcctttagtaatgttccgcgagatttacttatcaagtttatgaaaacgaatggatagctaatttactaaaaaaactgcttaattagcaccaagctcagtttttcgacttggttggaccttaatagtttaccctacaattaaatttttatgatattttgaaattggtatagtatcaaacactttaaccgattaggattctggcatttaccattgtaccgttacccatggattgagaatctctgcaaatcatgattgggtcgcggggtattatttgttcatatagtattgcaattaactttcgctatctttcctacgcataattcaagcgctgttgtacgtttggaagaagaagcgcacggctcgatctgatgtcttgctaatgggcttatgcgattcgggcaagacgctgctattttcacacctcatcttggacgacgagaaggagacgtttacctcgatcaaggagaacctcggctatctcacgacttccagcggcgagttacgcttggtggacattccaggtcacgaacggttacgcgggaaattcttcgaccaatacaaaaacctgtccaaggcgattgtatacgttatcgatagcgtcacggtgcagaaagatattcgtgatgttgccgactttctgtacacggttttggccgataaagctacagtaaatctgccggtgattattctatgcaacaagcaggatgaagccttggccaagggcgagggcgccatcaaaagtttgctggagaaggaaatgtgagttgaaatttcgttttctacatagtatatcattaactatatcaatccaaactcttccagaaatttggtccgtcagacaagaactagtcagttgcagtccgtggatccccagagtacggatgctgtatttcttggtagacaagacaaggatttcgaattcggacaggtctcgcaaaaggtcaaactggttgcctgttcggctaaggaatgccaactcgatgatttgaatgcatttttggatagcttataagaatggaacgataagacttttgttcgtattttttcttaccagtaattatttaaggattgtggaggaagtatctagggtaggtttttttggttttctgttttatctcgtatcgaagatggttgatgttatgtatctttctactaatccagtgtgtcctattttctttaataaatctataaaaaaaacaatcgttttacgaaaatatgtaatgttcttaatagattgacatggtatcatacatggtgtcattctgctcctgaatgtagactatcataccaacattaaaatgctaagcattactttagtaacgcaggctttgaaaagtaatttatatgcgtgcatgatttcctccattcaatatgcatatattttggcgcgctcgtcataaaacacgtctaaaatttaccacttattgtgaaatgtaataattgaagatgacgaaaattgcttacggaaatgtgcggcatgatgactttaatttaaaatttacacggataatcacagaaacaaatattaaactataaattgacacatatattgagctgttcagtaatccaatccgtgtggtatttgaatataattaattttacgaaattaattaatcaatataattaatttcgtatggtatttgaatataatcattacgcgtggtgaagatggataaattatgagtgaaattatgaaaaaagttggaggggttgtgtgcaagacacgaccgcagtgttgacgttggataacataagacaggttcaaaaaggatatgatttcgaaaatggtcttaatgaagggccgattatattgggcggttttacacatagttcagtttaacgcagcatatttcatttattccaaaattgtttagagtgagataatgatatttatgtaagaaatatgattcaaaacaactcatactcttgaaggccctgaaaaactataagggtacatccctatggggttacaaactggtaattaaaaaagttgcaatttagcgtgacataatttgtgtaccatcccttatggtttgagagaaatattat

SEQ ID NO: 185 - DNA, 2196 bp, Aedes aegypti
aactactattatttggtcaattgcaactccgtccagttttcgagtggcaaacatggacaaattagagtttgtcaaaagtttgtccaccgtgtactgacctttggtaaataataggcaaacgacttacattgggcaaacgtctgaaatgtcaaaaagccaaatctcgcataacttctgatctcgccctaaaagccattggtaaccatgcgtgtagctcgttgtttctgagcatttgaatggattttattgctatttaacaacgctatggggaagaaaggatcattatctacctgtccgtgatgttggtttggatgcttattccttcttttgctcagaaacaacgagctacacaggtggctaccaatggcttttagggcgttatctcagagtatgcgagaaatatttgcacacttggcaaaatggtggtaactcgtaacgatctgaggatttgcccttttgaattgtaacgcggtaagtgtttttttcgattgtgcatacatggacatccctattttaccaatgtcatcttccttctttgattgaaatatttcaagccctgtttgcaaacaaattatccgtcgtcgtaagatcgtgctttttcaaattaatttaaagaaatccattaattttagtgtattacgcgtttaaaaatgcaaaataaagtggtaaccctcaaaacgcaaacgcccctctacgggcagttggtgatcgggcctcccggatccggcaaaaccacatactgcgccaagatgaaacagttcctcgagaagctggaacgaaaagttacggtggtcaatctggatccggccaacgacaacatggagtacgaaaccaccattgacatcatgcagctcataacggtccaggacgtgatggagcagttcaatctaggcccgaatggagcgctcatctactgtatggagttcctggaagcgaacttcgggtggcttctggaacagttgaaggcctcgccggacaagtacttcatattcgactgtcccggtcaggtggaactctacacccatcacaactcgatgaagaacatcttcgaacagctggaaaagctcggatatcatctttgcacagttcacctcgtggagtctcatcattgttccgaagcacacaaattcatctccactttgctgctttcgttacacaccatgctgcagatgggattgcctcatgtaaatgtcctcaccaaggccgatttgctcaaggaatacgaatccaaactggccttcaatctggagtactacaccgacgtgttggatttgaactacctcttggaaagcgtggacagttcaatgggaccgaagaacaaatacaagaagcttaacgcggccatcgtttcaatggtcgaggactacagtttggtttctttttgtctgttggattgcaacaaagacgaaagtttactccggctgaagaatgctatcgataaagcaaacgggtatgtgtacggagccggggaagagaaaaacgttaacaccctgttggcttgtgcagttggggcagaaacgcagactgaccgaatggaacgggacatcaatccgtatgtgagctaatgggtatggaataaatgagtactaaagcaagcttagatggtgagaaaactggaaagaaatgtccttttgatctggcgtaaggaagaaccaacacttgaaggtaagtgtcaatttgcattattttttgcacaacctttggtaatcatagttagcaaatgctcatcacctccagaggttcgttcctcgtcaattgggagaattgtaccatcgccatatttcatcttctaccccaggcctggcctatctttctgaatcgcgggccaaatcaaagttttttgggagaatttaataagaggtttgcttgctgagcattttgctcaattctactagaagccctcaaaggaggatacgttttttttttggattttatgatatttttgttctggattattttcctttgaatctggtccgaaggaatatccgtattaacataggagaaggtatcgatcgtgattgttttatattctattttgttatggctatactgccgtgaatcgcaagtcagtcccatctgcattctcgtcaaaattgagttgagttcagttttcaacatatctttcaatgctctctcagctgcactaatgagataataggatttgttcggaaaaataaggaaaaaaaacaccaactc

SEQ ID NO: 186 - DNA, 22273 bp, Aedes aegypti
  misc_feature (9528)..(12054): n is a, c, g, or t
  misc_feature (14477)..(20759): n is a, c, g, or t
tatcgtcaaaaatcaaaagttttctccaattgagtaaaatgttgtataaatttccgaccgattggtgggaaaatattgaaaatctaccgataaatggctgagttattagtatttaaaatcttacataatttcgtgacggtcgcaacattttagattttcaattgacacccagtatattgccgtaggacgcagttaacgtcaaaaactggttttgaaaatttataaaacgatgatggttattttcctcttaaaataatctttactaatccggtaactatatttattattgagtgcatgctggattctgcatgcatttatccgccaacttagccctcagttcatgttcgaaaactgacactttcgaacttcgcgacgaaaagcttttcgaactctctcgtcatcatctgccaaagtcagaaacaaaagccaaaagtgttttgctgtttttcctgttcgaacgcgaatccgcagttttacgtgttttccccgctacaagttctgatcccgttgtgaattgttgcgtgccaagtgcgaagtgccttcaccgccgccaccgccatgagctcctctggccgcgagggacattcctccgggatgcaaatgtccacctcgagtacggtgctcagcatggcggagaagcaaaagtacatcgaggattacgactttccgtactgcgacgagtccagcaagtacgagaaggttgccaaaatcggccagggtactttcgggtgagtatcccggggaaaacccatccggaatggcgacgatgtggaattccctcgaatgttttgttttgcttttcccagggctggtagcgggctttcttttgttttttctttggggtgtctagttagacagctaagaccgctcacggtccatctcgccacggggctctcttgagaaactcactattttgatgcaagtatctgaaaagtctctatctccaagggaaggtctctaaattctctattttgatgcaaataacctcttcttcgcaaattggagggtgaaaaaaccctccccttggttatgcgaccttgccgcgatgggagggcataatccattagcccatattatggaaaccaaaggcgtaacctgtagtggtggtatcacattttggcattttttgcttaaagccgcgtcataattcatatggcatagacgcaataatatctcggatgtgatccaacggacattctgcgtcattgatagaattgatgcccatttcaaataattaatctattcgaagtgggcattaatactattggtgacgttcagtttgccttttgctaaccagaatgatccgtagccactcttactattagctagctctagatacatcgttatcatatacgacgtagggaatacttaggaaaatgactagtagattcactgagtagaaataagtggcgacaatcttattttaatatggtttttacattgccataataagaaatacctcttttgtaacagcggtataaataatctaattccagcttcattttcgcaaaaatagaaagtagaaagtaggcgttgtgaagcattgcatttgccatcgaaaagtgaatcttgtaggagactgtaatagaagcctaaggtaactttactcttcaatattcactataaaaatgactatggaaagtaagacgctgagatcgatcattagggtacacttgctagtttcgaaaatttgttgaacagacaaggaaagcgacttttttctttaaggatatatgaacgtaatgaccaataaatacttttaacaacaaaaaatgaaattaactagaactactactaaacagcctgattttgttaagacttgacgacaattgacatttaagactctaatcttacgtaaaacacaggagtaatcagaatagcacttgaatgacaaattattcaaaaccatttcgactagacagtattagtaatgacactactacactactatttcaaacaaattctgatggagctgctgattttcacaatgcttccttttctcagaagcaagggaatatgggtacttctcaaaaactaccacgtcacaatactaataaaaaagcagtggtcatgtgggcgccattgcctagtccgtctgagtattggtcctggtagaggggaaacttggcaaaagccagaccgagggttcaaccttgacaagttaagctgtcaggcagctccaactgaataccatacaaaaaaaaaaaataataaaataacctcttcttcgcaaattttgataatgctccaaagaaaccgtcagagattagtagagcctctgtacgtgtcataaattcttttgacttttactgtgcgccgtatgtaactacttagcatcaaatgcgaatattgtttgaagcacgactgcattgatgacatttgctagctgtttgcttccatcatcattattcatcattgaaaaagcaaagctaccatgttcaattttgtaacatgtcagcaattacgccatttggcagcaactttaaatgctgtgaaatgaggaatgccgtatttccgacgattttttacaatttatccgtaattctgataagaaaatgatgtactacaataatgttccaaaaaggcaaaggaatgatactacggttgaatttttatgattagacatgaggttaagaaactcgtagaacaaaaactgtagttgtagttgtaaagtacttataatacgttcaactagtggtatttattttgattttaatttttccaaattctcgttagaattttttattattgcaaataggactaggagtgactggttgaatcccagacatttcgatttttgtgaaatcgtctaatgcatatgtttattctacatgtttttctagtgacatatctactggaataattgaagagactccttcgatctgcaattttttttaagaaatccttcgagtgatatttccatggatgcttaaaagaatttccccagaatttgtcctatgaaatccttacgcacttcaacattattacctccaataattttaaagggattactcttgaaattttcccagagactatctcaggatttcctgatgatggtttttactctaaaagatatttttaaaattcgttaagagagttttactataatctctacaagaattcctacgccaatatttctcgctgaactttactgaaggtctaatgagagattctctcctctttcactctttttcggttttagcagtgcaataacttttgggatgtttttcactatagacaatgaccatggctagcgtttcacactaaaaacgcaacataagtggtaatgtgattcagttattgttccaaaaaaaatcttatgtgaaccttcaagaattcttccactgttaataatcaggaatcataatcgtaaatttcgtcaatccgagaaaattttactctcacagaattttttcaattgaattgacctgaaattcctcataaagttcctttagaaatttctctaagaatttgttcagcatttaattcatggattactcctgcagttaaaccaaacatttctcaagtaatttcacaagtaaaatttttatgaattcttaaacagttcatttaagatttcaaactagtttcgccgaaaaagacaacaaattttcatattaataacgtcatgcggtgaataaccttataattggcaaagatatctaactttagttcgaatagcatcccgcataaatcgaaaccatacaggcactgtttcccaaactatccagaaccacttacgacaatatctaaacagtttcgaataacatccacaataacaataaaccaacaataccacaaacgggtttgacagtctggtgaattgttattggacaaataacaatgtggggaatgggcggataagttatgtaaccatttaaaaatgccaaatttctcaaacaaaatttttcgtttactgtttgcaaaacagttgatatacagttcatttttgatcaaataatggtagggcaaattgtttcgattcagttaaaccattaaacttatggatatgcgaagaatgtttgtgtaattattgatttattgttctttatggcatttcaatcgttctctgtactgttctttttgataggaaatgacggggacatttataagaaatgatgaaacaagtagtgcgtgttttatatttgtagctcaatggaaagttgttcagcctataaagtgaaaaacaagttacttgcagaaaaactgaaacatttctgtttaaagtaccgtaaggacgccattcaccgctcatttaacagcatttcaacacattaaattctgtcaaaatcggtttttcgatatttttcccaactttttgcgctagacgcaagataaaacatttgtttttgtaggaaagaagttgaaatctgaacaacgtataatggtaccgaataacatgtatgccaatgacacatgtgtagggcgccattcaccgctcatccgaagtatgaggctctatacagtgttgtgaaaaactcaatttctcacaactcacgcttgagatttttcatgcgtgagttgtcaatcatgcaactcagcagtcaaaaaatcatggatgagttggctcacctttttgactcattgtctcgtatttccacagtttacttacacatggcaataatttcttgttagtctggtaaaattatagtaatcctttctaacgtaaacaccaacattcgggtttcacgagtttttgccgggttttgcaactgaatcattttttacggtttgagttgattgagttgattttgcatcaaaatctcaagcgtgagatttgcgaagcagatctcttttgagtttgctctcacgggagagcgtattgattgagattttgagtgtgagtctatcaacactggctctatatacacaacttgttggaattaatttactttcattagctggttgttatctttgtgctatagtacaacaacatattaaagcatggcagctaagaagcatttttcgatctgccataataaaatcattgttcaactcatgtttacagccttaaacagcctaaaattattttttataaatagtatataaaattaaatcatatgaatttcattctgatacaatccattctggtatactcatacatgttgatgacttttattgcaaaaatttgttcagatttttcaaaataattcaatgagcggtgaatggagcatgagcggtgaatggcgtccttacggtacacttataaataaggccccaagcacaatgtgaacggcaacgcggtacaacggcaaaacggcatgcccattttgatctacactttacttatcaatccagtgttgactaaatccttttcaacattgacttaacaagtagagtgtagctcaatatgggcttgccgttttgccgttgtaccgcgctgccgctcacattgtgcttggggcttaatacactacctcaaaatttagactacacgtaattcttgtttcattatttcctattcgaaataaatctacaataatattgttagagcatcataattatattcaaactataatactttaattcaacatatgagttgtgaagagcatatcaatcgtatgctaaaataagagcgtaagtaacatgattgatttctcatcatcgatgctatcttttttgatataaaatgacaaaatgcaacatttcggtcaggcgataaacttttaacgcttttactacgaaacttttgtatgggtcgtaatacttgagtcaaccccctccttctctttcaagcattacataattaatggacggcgcctaacaaacttccatctttctcgcataacttatgagctggtccaaaaagccattgttaaccgagtgcagctctagctcgttgttttcaagcaaatgaatggaaaaaaagataaaaactagaggaagatcttcacttcatcttagcgttgttaaacaatgtggaaatccattagtttgctcagtaacatctagctacatacttgattaccaatggtttttagagcgaggtcataaattatgcgtgactttattcaaagaagagcaaatcgatgaagagtaattgatcgttttacttacgcccttattctagcacacgcatgatatggatttagcgccgacgttcccaggaaaagagccattcaggtcgtcaacattcgattcttggccgcgattgcttccatcccacattaatattgaataaaaaaagaaaatgaaaaatgttagaaaccgtaagagagctccagctacaaacacttaccaaactcaaaaacattcctgctggagcttttcaaatcatccggaacgaatgaggtacggaaaagatctaatctgcgcctgtttgttcgttcgatgaatgaaatggaatcacggccgcgaatttcactgtcagctctgaactctgaacagagcttcaacactttgttgaaattcttaaacatgcgcaagtttcgggagttttcttcactctccgaatgctgctttcactatcggacattgaaattgtatcctccggagtgatttcaggctaccgaggccgctagttttgccgtagaggcagcagaagtaattctcggaaccgcttatttttttttatttttttcactggatctaggaaaagtaaacatgacacgttgaaaaaaattcacccaggtaaaaaaaatatgtttcacaaatttcgctggaatgttctatattatgttataaacataataacaaaagttttgcacaacatttatatcgtcttcgcttttctgatgaggtagtgtaaacaaattcctgtgaaggtaaaaagatgtgatgccagaactttaattcataaaacaattataattttttagcgtttgtataatttcatactctaccgtttggctgattgtgacattaatgttgcaccatttctcagaactctgcacgcatatattgtacaacaataattggataatattacatactgtcacttttccgtacggattaaataaatagttttttacagtttaaaaaatcaggctttatattgtgaaacactaatcctaatgtatgtgaaacgttaaccttaacagatagaagatttttattgtgatgaatgtaagggcaattgtaaatttctatgcgggattactttggcaaattaggggtatgtgagatgaggcgcgaaaaaatccaataagtaacttgactttcgtctctttaatgaatgtttgaatcctctgagcagaatctcaaatagagaaacttaaaagcagatggagtaccgtgactttcgtatcaatctccgaaaatatgccaacgatggatagaactgttatatacctactgttcatgccaaaggtgaacaaagttcagaaattcatattttgaccaccatgctcaaccatccacatccactgttcaagcagatgtcgcctgtagacgaatccacgcattcgttgtaactatttctgtgaatcactattaagcaccagatcgcaaagaggtaaaacaatcatctgttttgcaactctttccacggccttttgcaatagaagctatatttggtctggtacaagccagacagcactgccgtgtgatgttgtggaaagaaatacctacatctagcctgccgtatccatcgacagtatacgggacagtgtagtactctctcttctatactgtctctccatgctcttcaacagtagccagcaatagcaagaaggcctcatgagttcgatagttgatcgccgaccgatcagtacggcctacagcaccccattaaacatttttgacagttcaacagccgacaaaattggttgaaaaatcggtcgattgttgcactgacgcttatggaagtttaacacagcgatcaactgattaatcgctagattaaatcgcgtggccggagaaatctgatgtttagtaggtcaacttgcttggattttacttaaatacccgatttattcacgtatttagtaggaatgcgtcggcccacccttttaaatcgggtgatattcgattgatccctgtgttaatcttccataagcgtcggtgcaacaatcgaccgatttttcaaccaattttgtcggctgttgaactgtcaaatgtttaatggggcacattctgggtgtgctctgcgcgcgctacttcgtcgtcgcacccttcgcccacagtctgggtggagtgatacacattaagttaatagggtaacgactgtttatttcgttcataaccactaacagttggcgccagcggcaaaaattgcagacaacaacctttcgaacattcagtttctcttaccggccgccgagcggcgacactgatgtttgtattcctctcactgatcgcgctacgctggattctcaaatttatcaaactttcaacacaagcgcatggaagaatggtagtcggagagctgtcaaaacgtatggaaaataatgaaaatcgtaaattgctcgcaattaggaaactgaatcaaaaaaatagtgattagaaatcaagtgtaaagtgaaagcataactttttgtgtttagttcatcttccgtggtgctttctttgcttcaggatttcgtttttactaccattgaaaaagagccatctattgccttttcagttttgaatatcgccctattaccggttgaacatatgtatatagtaaacgttcaatgagtgtgatgcacggtgtttcatttaattttagcattttagagcaaaagtttgagacatttcaagacattggtacacattttcaaaactgtcgtggagcacttgctatggcttcgcggagcatgctatgtaaatcgctggactattgtttccaacctgtttgctatacaatgatcgggatggtgcaacatacagtgcacatcacatcatcaagaatcgcaaactaattcacattaaatattcattatttaatagatgaacgtatatttacaatatttacatttggagttttaattacaaaatcacttcacccaaacccggtctgtgggctaagggtgcgaaaggcggcgaacgcgcgagcggcacagcttggttgtgatgaggatggtaatgtatcgatcgcagtcaacgattgtactgatcaggcttttactgctgttctattaagtaggttgaagaagaacaaatagatggtttgcatcgtctgttctggctcgtatattgtgtatacgaacgtctagaagcaggttctctcgatcgaacaatactgttgttgcgaaaaagcatgtagtgggcatcgatttgaacaatgggtgaaggaggaagaaatagaggtcaaaacttggattcacatttatgattcaagtttggcgtgaacacctatcttaccttgatggctacagcgtagcgtcacgccattgccgggcgtattgtagctccatctttgtcggtcttgggcgaaacttctccagttgccccgaacgtttagggtcgccaggtcctcttccactgcgtacagccagcgtattcgaggtcttccagaagccgccgacctctgcatgattcttagctgaatattatattcgcatgttttttctttcgacattcgcactaagtggccagcccactgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccatatattcaatgtaaaatcgaatctcaagatccaatcgatctgctagtttagaagttagatttttcattccaaacaaataaactaatggtctgtggtctgttctaattttgaatttacgtccatatatatatgatttaaagtaatttatagaccagtgtatagcagctaattctttttcaattacagctttgttctcttcaccttttgtaaaagttctactagcaaatgctataggtagatcttttccattgtggttttgagacaaaactgcaccacatgcgaaggatgaagcatcagtggttaaagtaaaatctttcgaaaagtcgggaaattgtaaaatttgaggtgaaagtagttttttcttcaaattttcaaatgactcctggcattctgatgtccataaaaattttacatcttttcgtaataatttatttaacggtcgtgctattaaagcaaaattttgaatgaatttcctataatagttacaaaacgcgacgaatcttctaacttcatcagcattttgtggtgctggatatttttcgatgattgaaaattttgcgtcatcaggtgttatacctttatctgaaattttgtgacctaaatatgtgacttcacttttaaaaaaatcacatttttcaggatttaattttaaattgtacattcttaaacgttcgaagacattttctagatttctaagatgatgattttctgaacagcctatcacaacaatatcatctacgtaaacaaatgcacattccggtgatagtccagccattgcgatagtcatcatcctttgaaaactattaggagaaatatttagtccaaagggtaatcttgtatattgataatgaccatcgctagtggaaaaagcagtatacttttttgaattattttccaaaggtatctggtgaaatccagacattaaatctaatgtagtaaaatagcgtgctctacccagttgatcaagaatggtttcaatccttggcagtggaaatttatcgggtaagatgtttctattcaattgacgaaaatctataactagacgccattttttaccagagtcagatttctttggtactaataatatgggtgagttaaaatgcgaaacagatggttcaatgataccatcatcgagcattttcttaacttggctatttatttcagtttgttgggaatgaatctgtttgtagttaggaatgtaaacggaggtattgtcaattaattctattgattgttcgtaaaaattatttgctgttagcctatcctctgatatatgaaatacatcattatagttcatcatcaatttgtaaagatttttctgagttttgtgtgaattttcactttagtaattaattcttcaatcctattactatgcttaatgttcgaatttgagacgttcattattttataacaacttagttgttctaaagtaggtttgaagggttttactactacatgctcatttaatgtattaataaattttacgtaaggatttttcttatttataatggagtttcctataaaaattccatgctgaacttcttgtgagcaaacaagtagttcatcttcttcattatctggaacgtcaattcttttcaccatttcacatcttccaggtataataaattttccatctacgttatcttctatgggaatggtaaaaacttcgttacttatactgatattaagcaaccataaatcataatctattgtacaacgattatttacaaaaaaatctcttcctattataccatctgtcggtattggaaagtcgttttcaactatgtgaaaaatttgatctatcatatgttcactaatatttattgtacttttggtactacctagagaggctattgtaccttcacctatacctactatattacaattttgatttgggaagtatgttttggtgggcttaacacatttcgcattgatcactgatatatcagaaccacagtctacaataaatgtacactgagtgtctgacagatcagttttgagcaagacaaaatttgatgctgaaactcttattgagtacgcccgtactgtacctctaaaaaaggattgtttgtcacttgttgttggtttgattggtttgttgattgttgttgactagaattttcctgtgcaacatacacacgagaattcgtacctattctacctcggttatttgattgatgactgtggtttctatcagggaaactgtttgtttgcggtcgtggctgatactggaaacgatttgcagtatttgtgtttcgtcccctataagttgatcttctacctcgataagtagaagttatcatcctaggctggtgatttgaaaaggttggacgtggttgataacgtggttggtggccattggtccagaaaacttgtttctgttgactttgatcagcctccaattcagttaccttggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagctgctgaagcacgaaaatgtggtgaatctgatcgagatttgtcggaccaaggccacggccaacaatcgctaccggtcgacgttttatctggtgttcgatttctgcgagcacgatttggcccggattgttgtcgaacatgaacgttaagttcagtctgggtgagatcaagaaggtcatgcagcaactgctgaatgggttgtattacatccacagcaacaagatcttgcatcgggacatgaaggctgccaacgttctgataacgaagaatggcgttctgaagctggccgatttcggattagctcgagcattcagcataaataaaaacggtcaagcgaaccgttacaccaacagggtggtaactctgtggtatcgcccgccggaactgttgctcggcgatcgcaactatggacctccggtggacatgtggggagccggatgcattatggccgaaatgtggactcgttcgccaattatgcaaggcgcaacggaacagcaacagctgatcttcatttcgcaactgtgcggatcattcacaaccgaggtctggcccggcgtagacaatctggaactgtaccagaagatggagctcccgatgggacacaagcgcaaagtgcgcgatcgattacggccgtacgtaaaggacccgaacggggtcgaccttctagataagctactcatcctggatccgaaagagcgcatcgatgcggattccgcgctgaatcatgacttcttctggactgatccgatgccaagtgacctgagcaagatgttgtcccagcacacgcagagtatgttcgagtacctgacgccgccgagacgcgcctgccagatgcgccagtatcagcagcagatggtcaacacgatgcagcagcggccgcaggataacagctaccaggaccgcgtgtattaagacgatgcagcgggccggagggaccgtgcggtcgtatgactagatctttctctgataccattacctattagtggctagaattaatgaactgtttagctataatcatttatattttctgttttggagaatacaacgtttactttataacgcgataacctgaatcattatcccaataaaagtttgaaaaaccgcatttaacatatctcttgtattctgcaagaaatctcccttttcgttttttactttatggctattgttactaaaatctttcgttttttactgtttttaatgtgtattttcaaaggttcttgaggacaatgttgtaatttataatttattttcatattcaaaaattgttagccctactttacatttatcacaccaacaccaacactgaccacggcggtgacccgacagactgttattttttaaaataaaaccgtcaaacttcccagagtagcttaagtgcggttttctgcatagttaactggtttaagtttaatttaatgtcgttttctatgttgaaccgtttgtaaggtaaaaaaaacaaataattgttggtgctgattatggggcctattttgtaaatcgagcagattc

SEQ ID NO: 187 - DNA, 16884 bp, Aedes aegypti
aaccaaagacgtgtttgttcgaactgtgtaatatatgggcgaacagttcgtatttacagaacctcgaacagttcgcgcgaatattgaacgaatgtttttgagcgaacgttcgtgcattgcgcgcgtagtgtaatcaaggcttaagtgttacgtctgtttgtctgtgtttgaatcataagaatagagatagaaaactatagaggacgaatgtcgctgttgttccctttgttctcgctcagaaacatgtcgggtacataagtgtcaaactgcatactttttcgcgttgacatttatagccccgcctatctccgccagcaaaagatgttcctgcagcgacgccagcgacattcttcctctatagtttattacctctattatcataagtgatcgtttccaagagtgcattgtaccgacttgtgtgcaacttgcccacttccacgcaaccttcaaaatttcttctatgattggtgcccccactaacttgcatttgaaaccttctgaaacgtcgataaagtagaacttattgcatgatgttgttgttttcgtattcaagtctgtcagctgtcaaacgccggcaaacaaaaattccgccaaacttttgcttcgctttgtcgctagctaccaaactagcacgcattttgaattaagtcggatctaaattcaattaataaaccttaacaaaacttcggtttgagttaacatcataattattgtacaaaaagtgatcatcccagtggtagtgatttgctgtgatcgtgtttcatgtttatccaggaatagaaatccgacacggaaacattacgtcgtcaccgaactaaaccatccaaaatgtcgaaggtaaacaagttcaattacgattacaaaatgtaattctaagagaaatcttccgatttgcaggacatccgttcgttcttctcgatggggtcgaaggcgaagaaacccgacccaccgaaggaatcgtcgtcctcttccggttcgagcaagcggaaggtcatcgtggacagcgatgaggaaccggaagatcgcaacaagaaatcagttcccacgcccgagaggtccagttcccacaacaagaaacgccgggtaatcgactccgatgatgaggatagcaaaaagagcccggcaaagaagaaaagtagtagttcatcatcctcatctaagccggatttgaccaagttgaaaccggtcgatgcggcggactttttcagttctgcgccggtcaaaaggaaagaagtcccgaaaccaaccaagaaagccatcaaggaagaaatcgaaatccactctgatgaagagttcgagaaaacgttgctcgggttggaggaagtgataccggaaacgccggaaccggtcaagaagaaggtggtaaaggaaagccctgccaagaagaaagatgatagttctagtaaaaagttggacaaggagagtccggcgaagaagaaggaggagagctccgttaagaagttggataaggaaagtcccgcgaagaaaaaggaaactaatggtcatggacaccatgaggacaaacaaaaagacgaaaagaaaaaaacgcccacgccggagaagaagaagaaagagaaaccggtggtcgtgaaaaccgaaagcaccagtgatggaggaacaacaccaaagagctcgaagaaatccgccaatgagtccatcctaacggatgaggaacggtacgagaggaagcgcatgtccgcggcgctgtatcagaagtttaagaaccggcaagggccggccaatccgggcagcaaggagatacccaagggaaaacccgattgcctggcggggctgcagtttgtggtgaccggagtgctggaatcgatggagcgggacgagtgtgctcaggtatgtagggatccaaatgtgttcatttggacccccataagctatattgtcagtaaagtaggaactgagtcactttttaataacttgggtactattttcgacctggtaattaaaaagttgatatttgcaaaatggtaaaatggtcactaaaatcactttttttggtgatggcaaatagaagaaaatctgaagcagcttttcggattcaaagtagagtagaacggggcaagatgaggctgattgaataaatttcattaaactaaagtcaaatactgttgacttagggaccattgaactgctgtccttgatgaagttattaggaataataagaattctggaactataaaataagggtaaattatcacaacttgtgaaaatattgtattttcttataataagttaccagaaccgcgtatttgccgcggattcaattttggtcaacgtggatttggaacgtggaacatattttggacttcccgttccaaccctgatatgtttcttctcattgctgtgtatagttggagtccctgcagagatttttccagtagttactctagcagatcttcgaaaaacttctacagaaattcttccaagaaaatccctaaaaattcattccagatcttttgatgaaatttcattagggtttttcgagaaaccctcaaggatttccaatgtcaattttgtcagttatttctcatatgaatttattcgtaatttcatccacggtttgtctcaggaattgctcaaaaattcttcaagggattattccaggaaatctaataggaacctccaagaatcactcgataaattcgaccaaagattctaatcaaatgtctccataaattctcgcataacttctgatctcgccctaaaagccattgtaaccatgtgtgtagctcgttgtttctgagcttttgaatgtattttcatgttacttaacaacggtatggggatgaaaggatcattatctacctgcccgtgatgttggtttgtgtgcttattttttcatttgctcagaaacaacgagctacacacgtggttaccaatggcttttagggtgttatctcagagtatgcaagaattttgctatattctatgttgtctctcttttcgcaatcacttctaatcaaagccgtagcgttgcctcatggcgcccttggcaaacctccatttgtgcgccccctagtcaaagtgaaaactcaaaaactttgtttgtctttaaatggaacaagtttacgttaaatatattgaaaaaaaaaatccaagaggtttcgttttgaaagagtattatgctgaatttcacggctttactaaattttgaagtttatgaaactgtttgtaaaaatctaacataccttgtataaaagaaccgtctggtgatattatcaagataatttttagacgaaattccaaaatttgaatgcatgtttataaaaaaaaaccgcagatagtgcttgatacataagacaattagtttgaagttttttgtgaaatgcaatgagcaaaagcatataatttgttagaggctccaaaaacgttaattaaaggaatcttatttatattattgaatcattcatttttgcgtagttttttagattgtttctacagttttccgtagaaatcggcagttgatcctgtcaataaaattttcagcacaaatttattcatctaaaaaaaaatgaggctttaaaaatttccctatgttcttactttttattagtatcactaaaattcatccaagtcaatttttaaattatctccaaggacttattagaaaacattaataatttgagaacatttgttgggcagaaccagaaggatatttgtaaattattttaagttatatttatttatttatttatccagctttttacgctgggtagctataaagttctggatcacccccacttgatgtttcttgtctacactataatttttatggttagatctcagcaatcctagaaggatagaaaaactttgatgttgacaatagtcgtcagattttttttcaatccaactaacttgatcaagtattaattttttttatctattttgaactcgtatacgattacaaacagtttgtttttgcaggtttacaacactcatcgagtcgaattagccatataaatactaatttactaaatattggaacatggacttcaaagcatgaactgttcgtttgaaatcttcaatgaggtcgtgctggcctatgcagttgaaattcaattaaactaacaccagtatatctgaaaggcataagctagaataataatttgtctaatgcttaaaaatctgccaaatttcgctgtcagacaatcgatgggtatggcctgatccagaagaaccaaacagtattcaaacagctcgaaattgtgttggaaatctatcaaatgtcgctaatatatgatttgggatatgggtacctgaatatacatttcatttatgcgagatttcggaaagaaagaagcatgattgtgtgtttaggtttattttattcatacggccaagactaaaaaaattaagttagattgcacggtttttcgatttcttgatccaagtgaaggttgttgattgatgattattttttggaatggaatattaaaatgtagggacatcttcttctaagtttgtcttgaacagcagaaatctatgtcggaagcctgatattactagtaacaataactgagatcagatctcttcaatgtccatatgtacctattatgcgatgttcaaattaaaacccacgtattcgattgattggggagcctaaaatcacgtgaaataaataaattgaacaaattaatccgaaacattaataaaatttgatttacgaaattctcctaggtgcaacacgaatgtggtgaaaatttttgacaatttaataaacaaaccagaattacagcctgctatgattttgctataaaatctgttagcaaaatatgtcataatcatatcacccctcgtttttttatagccagcgtaaaaacctggatagttttattcgtaatataaccatcttgggacggacctggtgtagtggttagaacacacgcctctcacgccgaggacctcggatcgaatcccatccccgagatagtcactaaaaatttcagtgacgacttccttcggaagggaagtaaagccgttggtcccgagatgaactagcccagggctaaaagtctcgttaataaagatagaaaaaaaaaataaaaataaaaccatctttgctcaaaacttatttcttagccaaatataagaagactttacctgtaaatactaccattactaagagcctgaaatactcacgttttcttatgtcattgattgtgcgagaatccgctccttaaatctgcgggatcctgctgagcatcttgtaatcaaactttcctttttgtaaaaatcttacgcaagataatgtaagatttctgctcattattttataacaaaaaaaatcttcccagaatttgcgtttaggattgcatgaaatttatgctcaagtttctttgaatatattttaaagaattttgttgatatgatgatacaataaaactgtgtttgaaaacctatctaagctatctaagtgattatcgaccttctcaaagtttgaagaaatgtagttttaccaataaacagtatagaaagcgtaattgcggaaggatctagtgtgatcaaattaatataattgataaaaactactagctcattctcatttcaaatatcaatcgaacatcacaaatcagatttatttgtaaaacatttttcacggctattagagctcacaaaagaagagcgttgaagcctaactgcttaaattttggaatttggaagtaaattttaaaaaataatatatataaatttatttatatttataatttcaagtacttctaaaaagactcttcaacttatgaattctgtaatatataaacagggatgtcaggttgtttttttttttttcaaaaattttgatggttttagaaattttaactagaaaagacttggttttctatgtattatatggaaaaccttagaatgtcactataaatttgtatctagatcttccagatttttgtaaaatgtagacttaaaaatctggaatattccagacaaatctggaagtttggtaacgctgcttttgaaatgaacctagattttcttaaatttttcactgatatgttttccatttgttttccgttggatatgtttgtcccaaaattttgccatgtgctcattttggcgccccctgacggctggcgcccttggcgggtgccaacctggccaaccgcacgctacggcactgcttctaattaactttcctgtttcttatgtttcttactaggtcatcaaggatttcggcggcaaggtggtcggttccgtgtcgaagaagttgacccacatggtagtcggcgaggatgctggaccgtccaagctggcaaaggcagacgagcttggaattccacagatttccgaagacgatctgttggatttgatccgggaaaagtcaggacttcccaagaagggcagtggctcaagcggtgccaaagaggagaaagttaaacctaaagaggagaagtcgccttctaaagagaagaaacgtaaaacaactgaacatgattcggaagcccggaaaaagaaaacgacacccgaaaacaagcgaactccggataagaagcactccgaatttagctctccagtagcgaagctgccgaaaatcccaaagatcgaaaaacgttcccccgaggcaaagcccgtcaaaatcgagaagagttcgcctgtcaaaaaatcaccgataaagtcggaaccaatagctcccatcaaacgagaagttacctcctaccagaaggacatcaacagcaccgaaaacatggcctgggtcgacaagtataagccgacatccgttaagcagatcattggccaaagtggcccggccagcaacgtccacaagctcatgaactggctttccaagtggcattcgaatcacgatggcaaaaagaagctcgtccgaccgagtccttgggccaaaaatgacgacggtgcgtacttcaaggccgcccttctgtccggtccccctggagtgggtaaaaccactacagctaccttggtttgcaaggaactgggattcgatgcggtcgagttcaatgcatccgacacccgtagcaagaagctcctgaaagaagaggtctccgagctcctgaacaacaaatccctgttcggatattttaccgagggaggcaagggcgacaaagttagcaagaagcacgttctcatcatggacgaggtggacggaatggccggaaacgaggatcgcggcgggatccaggagttgattggcctcatcaaggacagtcatgtgccgattatttgcatgtgcaacgaccgaaaccatcagaagatgcggtcgctggtgaactattgtttcgatttgcggttcaataagccgcgtgttgagcagattaaggtaagtcggttgatagtgtatttaatacataccattagtatgcactcttaaaaataatgaaaattactctggacgtaattctggttatgactgaatgatacatgatgtaagtgatggaacgacacaaaaacgtgtccttgaagatgtattgaacaaaaaatgtaattttacatgttaaaggacacgaaaacgatggaactgtgatcgtcatttcccgaatcagacactaacgtatttgaaattggacaccaatttacgtcattcggctcgcttcttttatgtgcatcccaaaagacgtaaatcacattattttttggtactgtgtggaatcgcttcatcaagattgcaacactctggttgaacattgcaagacatcaagtaaaagctaaaacattaataatgagaatctcgaaatccttattatcagggctgacatttgctacagaatgtctgaaatttattggttggattctgggaggaattcatgatacctaataggattcaaccccatttccccggatccaattacccaaacccaaacgccattacctcgaatttcaaatccccgaacgacccatcatcccgaattccaatacatatcataagtgttgggtcccagttgttatcacaacaccacggtgtactaaaattaagaaggtgatatactccgaaaactgacagctacttgatgacgtcattcctatccacctcgaacaaatttgcgaaaaaaatgatctagtggtccggaaggtatatggtacgataggagtgacgtcacatgtttataatgaaactcgatatttacatcagtgaagagactgccttgttaatttttatgccgtgtcacaacaccatggaaacaaccaatctcaaaattgtatatttttaatcacagcaacccttgtacgactatataagggcaccgactgacacctcagtcttcattagttatttgacttccaatattgttcgtttagttgaggaatagattctcgtgcacattctcaacgtggaaaaataaatactcacacgtcagtttatatggcactttcatagaagcacgcaccttgcattcaatgtacaatcgaacataatgcgttacatgtgcgttacttgttgattttgttagctacgacgccatccaatatatggcaaacatggtgggagaatattttggtgtgacaaaattatttaggtgtgagtctattagagggcaaaatcctcaataaattaacatttaattgtagcagtaaaagtcaagctcttttcattccggaagtaatccggacataacaatttggcgacgaggatgggataactacagcaagcagtactccaaatggcagagctcctgcagaagctagcgcaaccaacaccaacccctagcaacccggagcaaacactctaggccttggcaaccaacatcagtgaattttcgttcgacgcggaaaacggagtcacttttgacaagtggtacagccggtacacggacctgttcgagacggatgccaggaatctggatgatgctgccaaggtgcgcctgctgctgagaaagttggacacgccgtcacacagtcggtacgttaactacatcctgccgaagcttcccaaagacgtcgatttagccagcaccgtcgaaaccctctcgaaaattttcggcgtgcagacctccatcttcaataagcggtaccagtgtctccagctagtcaagtcagaagcggacgacatcatcacgtacggagggaaggtgaaccgtgcatgcgaggatttcgatttcaagaacatgaagatcgaccaattcaaatgcttggtgtttgtgtgtggcctcaaaggtcattctaacgcagacatccgagccaggctactttcccgaatcgaaggcgaaacagcagaagctcccgtcactctccaaaccctgatcgacgactatcagcggctcgtcaatctcaaggcggacacatcgatgatcgagcgccaatcatgttcgaaaccatcggtccacgcggtccaggagaaaaaaggaaactctcatcagcagtcttcaaaaatggaaggtaaatcacctcgtagtccttgttggcaatgcggacagatgcactttgtgcgcgattgcccattttccaaccaccagtgcaaacagtgcaaccggattggccacaaggaaggctattgtggctgttttttttaaaccgaaatcagtttcatccggggaggagaaaacacacgccaagccaaacccagcaaacaaatcaagcaaaccccgaaaagccaaagccagatgggtgtacatcgtgaaccacatcgctgaaagttccagcaagcgtaagtacgtgccaacctttatcaacggcgtttggacacggcaagtgacatcaccgtgatctcaaagcaaacgtggaactgtttgggcaaccctccgatgaaaaaaccaacgatccaagcaatcaacgcgttgggtgaactgcttcatctgatgggtgagttccagtgcgacgtcagcatcaccggcaaaaccgctcggggaagatgtttcgttacgacggctgccaacctcaatctgttaggcatcgactggattgagcttttcgagctgtggtcggttctcctcgactccgtctgcaagcaagtaacggcgaagtcggtcaaccaacagatccgtgaattccgaacgaagcacgcggatgttttcaacgattcactgggacactggaagaaaatgaaggtaaagctttttctaaaaccaaatgccaaacctgttttctgtcccaagcgaccagttcccttcaacacgattccgcatctgtgcggactactcgacgggactcaacgaagcgttggaacccaaccactatccgcttccaacaccggaggaaatcttcgcccaactcaacggcagcaacgttttcagcgtaatatacctctccgatgcgtacctgcagctcgaggtgaattaagagtccaaaaagctgctcaccatcaacacgcatcgtgggttgtttcgtttcaatcgcctggcccccggagtgaaatcagcacctggggcattccaacgtgtggtggatggaatgattgcgggcatacctggcgtccgctctttcatcgacgatgtcatcgtgttcggaaaggacatgaagtcacacgcagcttcactcaacctactcttccagcgactaaaggagtatggcttccacgtcaaagccgagaagtgccacttcttccaaacacaactcggttatttgaggcatatcgtggaccaccgaggcatccgtccagaccccgaaaaagtgaaggctatcgttgcactcccaccgccaaccaatgtctccgaacttcgatcgtacctgggtgcgattaacttctacggaaggttcgtgcgcaatattcacgaactgcgtcatccgatggaccagctgctgaagaaggacgtgaaattgcgatgaactccggaatgccagaaatctttcgaccagttcaaggcgacgcttcaatcaaatctgctcctgatgcattacgatcccaagcttccaatcgtcgtggcagcggacgcatcaagcactggcatctgggcagtcatctttcatcaattctctgatggcagaatgaaggcggtgcaacacgtttcgagaacgctcgcacccgccgagcgtaactatggacaacctaagaaggaggctctcgcgttggtgtatgcggtgacgaaattccacaaatatttgttgggacgacatttcacactgctgaccgaccacaaaccactcctgtccatcttcgattccaagaagggcattccgctacacactgcgaatcgacttcaacggtgggcactcactatgctgaactacgacatcgagattcaacatgtgtctacagcgagttcgggtgtgcagacctgttatcccggctgatcgatcgaaccaagcaacccgaggaagaatacgtcattgcaacactcagcctcgaggaagatctggtaagcatcctttccgacgccgccgagaaagtacctgtttctttcgcagtgctgcggaaggcaacatcaacgaacgccacactccaaactgtcgcaaaatacatccgtgacggttggcccagctgctccaagaatctttccgctgcagttcaatcctacttccaacgtcgagaatcgctcagcgttgtcgacggttgcatcatgttcggcgacagagtcgtcgtccccgacgagttccgacgaaggattcagcaacagttccatcgaggacatccgggaatggtccggatgaaggcgattgcacgaagctttgtgtactggcccggcatcgatagcgaaattgaagatttcgtcaagcgctgcaacccgtgttcgactgcaggcaagacttctaccaagacgacactggaatcctggcccgttccttccaaaccctggtcgaggatccatattgaatatgcacgtccagtagatggggtttacttcctggtaatagcagatccttattccaagtggcccgaggtgcacgtaaccaaatcgacgacaacgaaagccacgatcaaattgctgaatcaaaccttcgcaacattcggcgttccagaggtaatcgtttcggcacccagttctcaagccacgaattccagagtttctgtaccagtcaaggtatccgccacattcgcatcgttccgtatcatccacaatcaaatggcctagccgaaagattcgtggataccctgaagagaagccttcggaaaatccgttcagggggagatacactagaagaagctttggtcacattcctgcaggtttacctggccgaaatgatgttcggcagaccgctacgcaccgtttcatcattactcaagccaagcagaagcgaaggaaaaatcatatccagagacaggacgaagcaaaacgacgctttcaaccggaagcacggcgcagtcaagagaggtttccagcacggagataccgtgttcgccaaggtttatcaagcaaactcctggcagtgggaaccagcaaccgtcatcgaggagattggatctgtaaactacaatgtattccttgaggagagacatcgcttgatacggtcgcatgccaaccagctaaagacacgtgttcaggaaagcagttcagcaagtcagccttctccactatcgatattcatcgatggtttcggactcccaactccagtagagacgtcgccaaccggcattcaggacgaacttccagtgccgcagcagttcgaagaaccactgacggccagtccagatatatcctacctgacggaaggtttctcagaggatgaagccggaagcaacgacgagtccataggcgaaccagccgaggacgaaactccgaatgcagctccagttgcaacggatgtagcagcccaaccgactacagtaatcctggagagaggacggcgcatgattcaacttccagcccggttcaagccatattggatgatgaaaccttaaggggggaaatgttgggtcccagttgttatcacaacaccatggaaacaaccaatctcaaaattgtatatttttaatcacagcaacccttgtatgactatatgacccaaatagccatagcggtaaacgcgcagctattaagcaggaccaagctgggggtcgtgggttcgaatcccaccggtcgaggatcttttcgggttagaaattttctcgacttcccagggcatagagtatcttcgtacctgatacacgatatagggtaacggtcgtattttgaaccccctaagaaagtaattttagtttttcgtcccgattaattaattgcacaacgtaatcaagtcaaagcacatgccaaaatgtagagaaaaacttcctctacgagataaaattgcccatacggtcatgtaggatccaaaaaccgtcgaaaataattgaattgtgaagcaatgcttttcattgttttggacacaccaatatattttggaccctcaaagtatatattttggacccccggcatttttcatcgtttggcgacaaagtccacgacactagttgtaaatttccagtatgttggaacatgtttaaatcttgatgaaactataataatttgcttcgagaaaaatataaagatggctaaaaaaaggtttattcttgtgttacgcggtatggaaatctgtggtggaactgatatgcgattatttcacatcatgagacaattcgacatgatgtcttttttataattttaccgagcgaacagtttagtctctttagtgtagcgtacctgaaagatcacaggaagatatgttgaagactgatatcaatttgttattttggcagtgaatgatatttgaatttttcttagcatgttgaaattttgtttctaatgtgtttccttgagtcgatattgagtcatggaacattgactcatggaggtttcactgtatttcagtttccgtgtaactaacggaaaaaatgattagaaattacttcaattccaccaggctcttcctctgtgataggttggttgtagaaaaaaataaaatatccaaatttttgtattacaccttgaattatacccaggcatttgtaggttatgaaacgatacaatttttcaaacattataaaacttttctaatatgcgtgttatggctcaaggtttaaaccaaaaataaaatcatcttgatgactcggaacaagaaaaattatcaaaaatttcaaaaggtatcccgtccaaaggcggggttgggtattagagcgttagtaatagtttcaggcacaccatgttatgttgaagtctctttaaacctttttatgcttgcagttaatccgggtgaagagtactagaggcttcagagaatccttcaaagactatgacgcgacttttctacagaattttcaaagaaagactccaagattgttgagtgctttcatctgatatacttttaggtattcctccagagatcccttcagaatttcctttaaagaattaattcttgcagtgatttttcaagaggtgtttcgaagaatttctccaagaaatcattaagcactccaacgctactacctacatggattactttgatttttttttcccagacactatcccaggattgcctttcagatattttttcgtttatccctccaattgttactctaagattttcccagctgtgactctagaatctaggatctagatctttccaaaattcatactggagttttccaagaaaatatataaaggcttattctgagtttttacagaaacacgtttattgtttcttgttcaaaaaccacgacctatttttacgtaattcattcaagcattttaaaatggattttatggatttcgctgagtgcagcaatatttttatgaattttgcctagccgattttttttgcacaatattaatgatttttttcagctgattctgctgattttcagcattctatgtgatcgtcgggatcatgtactaagtatgatcaatgatcatgatcagtggtttgaacaattttgttaaagacacatctttttaggtaattagaagtatgagttagatatgacttaatttacatgtgcacacaagcgccaagtagctacataactgtgcttcaaaatgttcatgatcgtcataaggcttctggataactttgctggagacaccgacattgttgatagtaaggacatatagttcaattcaggtgatgcttaactttttggggaatgttgcaataatcatctgggttgttgaaatatcaactctttcataattatggtcggtagcgtatcattatcaaactctcgtttcccccagggtgccatgatgtccgtttgtttcaaagagggccttaaacttgccccaggtgccctcgaggagatcatctctgggacaggaggagacgttcggcagacgctcaatcatctggctctgtacagcgccggaaagtccattggcgcaggcagcctcagcgtcgaccaagccaagaaggaagcggaaactgctcgtaaggatgtcaagatgggcccatgggacgtggtccgcaaggttttctccgcagaggaacacaaaaccatgtccatccatgacaaatcggatctgttcttccacgattacagtttagcacctttgttcgttcaggagaactatttgaaggtggcgcctcgagtacctaaatcccaactaatggatcaggtcgccctcgcagcggacagtttgagtcggggggacatggttgaccggcgaatccgatccagcatggcatggtcgctcctccctttgcaggccatgtacagctcggttcttcccggtgaatacatggagggtaacttcaccggccaaatcaatttccccggatggttgggcaagaactccaaagcctcgaaacggaaacgcttggcccaggagattcatgatcacacccggatcagcacatccggttcgcgtctctcagttcggttagactacgctccgttcctggtggatgcaattgtgcggcctttgaaggaagaaggctccgaaggggtccctcaagcactcgacgtcattaaggaatatcgcctgctcagagaagacttggaatcgctggtcgagctaacctcgtggcccaaacagaaaaatcccatggattcggtggacggaaaggtgaaagctgccctaacgagagcctacaataaggaaatcgctccatactcttactcggcggtcaacgcggtgaagaagaaacgagccgaagctgccgacgaaacgagcgaactgtacggagaggaaggggaagagaacgccgcggcagtctccgacgaggagaaagaggacgacgatctggagaacaatgcattcataaaggtaaagaagaagccggcaacgaagggagctggcgaaggagcgtctgctaaggcgactaaagcaagcagttcgaagggtaaagctagtacttccggaaaaggtaagaaaaaatagcgatttggagcgagatttttcaggtataccctacatgttaatgttatatgaatctgaataaatttaggttttctgtattaactcgaacgtacacgtagaattgatgtttccgaaattcatgataccatgcgtatagcacggtcggttcgattatattactagatttgcgatctgattggaaaattttatgggaagtatgctgccgttctacgcatatttgtcccgcagtccataaggtttacatagaacatgggacaagtaggcgtagaagggcagtatgcacttcaacagaaaagtaaacgcctatctcgatgcgtgggaaatttattgcaagaaatgctcaagaaaagcatttttctttgatcgcagtacattgttgaaaaggaatgtaaattcaaatagagctcactgtagaaaatttctttcgcagaaatttttacttttcttgagcggaacagcacacctatgcgatttccacgtgtaccgtctgcttacaaggaaagcatcatcagctcttcaagaataagggtactagagcaagcaaagtcctcgagcctctcgaactagtaaattcggatctacagtattggacaaaacatttgcaactttttcgattttccatacaaaatgaccaactttggtaagttatatctcagttatttatggaccgattcgaatg

SEQ ID NO: 188 - DNA, 19855 bp, Aedes aegypti
  misc_feature (5898)..(5997): n is a, c, g, or t
tgtcaaaatttcattcataaaataatcgatcagccgttcaaaaatgtctcgtaaaatggactatggaccgatgcacgagttcattatttgacgatcgaggggtgccgaattcactcgttgccatggtcacataaataacacggcaccgctaaaacgtcaaataatgaactcgtgcatcggtcctgagagagactcgcgaagaggaaaaatatcaacgtcatatgcagcccagattcccctctcacgaaacgtcaaatgcagcccaccgtttttatggctgaaaaagtgaaaagtattgtgttcaaagtaaattgttattgaaaacctcagtcagcggagcagttttttccaaagttgctgataaatctaaacagaagattaattattgctaatgctacgtttgctggcatgtaatttcactaacggctatttatgattcgatgtgatgcaaaatcaataattttttgctgagaggttcatgtgaggatttgaacggcttgcacataattggtataaacacaaagtggaataagaaaaaaactcagcaatcacagaaaaagaaaaccgtcttcgcgagtctcgtctcagcatcggtccattcggcaccgctcaaacgtcgaatcagtgaattcgtgcatcggtccatcatattattatgcttctggcaacgctgccatttgtttaatcagcaatcatcaaattgatgacgatggtagccaatttgacaactccaagtgtcaaaactcgaaaagtcacgtgagggaccatatcggaaaacggaacgaacaaatcgataacagagcagaggaaaacgggttacactcgaaacgttgtggaaatcgggaacgtcatatgatcactggtgcaaaagtttgagctgcaaaatggcacggataattttcctcctattttcgctgtttgtcgcaggtgagttcaattttgatcattaagaagaatgtctaatagataactgtagtatgggtaatggttttgaattggaattatgcataaggtctgcggttttccaacgattccagattactcatccaggaatgtttccattcctctcttatcgtgggcaaggacatgtagtaaaacaatttcttatattatccttattgtagctaactgtgatcagctgtcgatagtttatgcaccgaaggccctggaattccacggccactcccggttagatgcggaatctgtgtcggacgttttcggtgctgccctcggttattccgtgtcccaccccaccgaatgggatggactgaccgtgaaggatccattcaatatggccaatggcgccgttgtggtcgttgctgagggtctggatgcccttccgttggatgtacgctctaccgcataacgataacccgtgacacacacactgagttgatttttacgttacgtatctaattttagggtgctcaaacgtacgaattgtatggcggatcaggatcggactcgattggagaacttgttcaaaagtcagctgaccacaatggcgttagcttcgagatcgacctgaaggaatcggtaagtttttattccagtggttagacaaaagggtaatagaaataagtgaaattttgtcaaatttgtatcatgcaaaacttttttgataaccaatttttgaagtttgatgcgtccaaaagcatctggcttgaaatgttgtttcaaattacctgaatggacatactgactaatgaccaccaaattaggccatcgtaggatataatcacacaattttcgtcgtttatatgtacgcagggcaaccatattagttctcaccgtaaagagtacattgcagctttaaaagtacaggtagaaaaattctagaccgaaatgttgaaggtatcaaaagcgaaattctgggatatagatacggaaaaatctcaaaacaaactcttgaagagatgtcacgagaaatttaaaaaaaagccttagaaatatacttaggtctgttcaacttaggaattaaactctcatctcgtgattcatgatttttaagctagaggtatctaaacttcttatttctaattcgatcatttgctaccagccctgatttccctaatatatcatctataggaaaaatagaaaacgttctccagaataatattgtaggtatcaggtatcaggtatcagaaggccggctccaaaggcacgttccccaccagttgggagatttgtgccatcgccatatttgagcctatttcatcatctacccgatgggagaggaaagggaagggaaagatgggaggaaataggagtggggtcccttgaagagggaagatcgcataagcgaaatgagagcatgtagctccataccacaatgggttcgaacagcgccctaaaaagggcactgcaaaacgcatgagcgtaaagagagcctatagctcattaccacagcgggttaagaataacaggatgtcctgaagattcaggcttctgtattcagtttcacttaataagtgtttaccaagtaattggaatcgcatttgcgcaaaaactggacagttacatatcaggtgatacgaagttccataatcggagtcacaactatcacacacaaatgagtcagcacgctgaatatttgccatgtgatagttgagtcggcagtggtctgtcaacgctctgaccaagagactgcaattctgctttgacagatttgttaaatacttcgccacctttggagatggctcagtaatatacaattttgtttgacgacacgactccaaactattccaatattgcttgtgctgagttgccgcccaagagtctatctgaagtttcacccagcacttcgaaattggaatagccggctcagggccaatgaagtcatgcgatgctccatcgcgagctagctcatcagccaattcatttccagcgatggaagaatggccaggtacccatacaaggtttacagagttgactgaattcagttcctcaatttgagttcgacatgcgataacaagcttcgaccttgagttggccgaagcgagagcttttatagcagcctgactatctgaacagaagtatatgactttacccattacgcgctgttgaagtgctgattgcactccacacataagagcaaatatttccgcctgaaaaacggtgcagtttctaccaagtgagtaaaactgattcagccttagctcacgagaatatactcctgcaccagctctaccttcaagaagggagccatcagtgtaacatactatattgtttgatatacttctttccaaatagccagacgtccactcttcccgtgaagggaattgtgtggtaaatgtcctgtaaggaaagttacaagcaattgtgagatcacttggagcaaggacaattttgtcccaattcaccaaaagtggaaacaacgaagtgtgtgtagatctacgattcactggatttttctccagtagatccagtacccataaacggtaagagcaagaaagtgcttcttgtttaagatatatgtgtagtggcgcaacgtcgaaaagggcctcgagcgctgctgtgggagttgtagagaacgcaccagacatcgccatcaagcacatcctttggagatggcccaattttgattggattgttctcacttcgcccttttgccaccacacaagacatccatatgccaatattggtcgaacaactgttatgtaaatccatttgatatatttgggtttgaggccccaagtcttaccaaaggttcgccggcattgaccgaaggccatacaagcttttttgactctgaaatcaatgtgagctgtccataaaagtttggaatctagaatgactccgacatactttacttgatcagtcacattaatctcagtgccaaaaagacgtaaaggtcgaattccatcgcggtttcgtcttttcgataaaagaacaatagatgttttattcgggtttatccgaaaggccatattggcgacaccagctttcggggaaccgacatgcggagaaaagtagcatcaatcggtcgaatagggtgcttatgcacataccaactatcagagctagatagtcgtcagcaaatccatatgttggaaaaccgctattattgagttgccccaatagcgtatctgctacgagattccacaaaagtggtgacaagactccccttgggggcatccgcaaacactcaattttcgaatcgctgcttgacgcaatgtcgagaagagatgtcggtttttgagtatttgatgaatccaattggtaatcattgtaggtagcccatggtttcgtgcggcttccaatatggcatcgaaagacacgttatcaaaggcaccctcagtatccaagaaaacacccaagcacgattgcttctgagcgaatgctttctcgatatcgtataaaactttgtgtaaaagagtcacagtggactttccagattggtaagcatgttgattcacatgaagaggcatgtttgccaaataaacatcacggatgtgatgatcgattatgcgttccagacatttcagaagaaaagaggtcagactgattggtctaaaactcttcgcttcctcatacgacgcacgtcctccttttgggataaactttacagtaatatcacgccaggatttgggaatgtacccggtagcaaaactgcttacaagtagctttttcaaaacatgtttgatagactcaaatcccttttggagcagaacaggataaatcccatccgctcctggagatttgaaaggagcaaaactattaagtgcccattgaatcgattcagtagttacgatactgcgagccgaggccagagactcgtaactacatgaaaagacatttggttcatccgtagatgctatgtccacatatccggggaagtgtgtattgaataaacattctaaaacttcttcatcggaagaagtaaagtcaccattaggtaagcgaatttcgttcacttggaaatccttagattttgcaagaattttgttcaaccgactgacttcactcaaactggaaacattagtacaaaggtttttccagccggatcgttcagcagaacgaagagccttcttgtaagccttgcgagctgacttgaacgactctgatccagctgaacggcgtctgttccaactccttctacattgtttcctgagtctagtcagatcggaattccaccatggggtccctcttgtagtctttacagaccgcagaggacatgcttcttcaaaagcttccataatgtaggatgttgtacaggcgttgcagaattcgctctcatttgagaatgaagcacgatcaaagcaagcaaagaaaaactcccatctgttgcggtccacgatcgtcattgtatcgcaaggtgtaacaagtctgataaatggaagcagcgagcgagagccccaacgagagagcgatgataaaatccatttttctcgcttgtttaccgttggggataggtgtttttctttactggcacgataaacaatccacgaacttccaatagcaatagtgtcccccaggcttggagcatgtttagaggggttttatcatgcactactatccccccaatctgatgaaacttgtagcagtatacgataaacagtctctcataatgtgcagcatgttatgatagttacagagagcgatacgtgagagattctctcaattttctcaggattcaatccctgatgttgtagtatcaacggcatcatccagatcacttggattttcaatggacggagaatatccatgaaatttagtcgcaaccaattcaatatagagttcccagtttgttgatcggggattcctaaaacgcaaagtctgcgcagttacatttgaatgttcaaagaagatgtagcgatgatcagataatgattcctcatctgatacatgccaattcgtcaactcgtgactgattctatcgagcagagcgttatgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagccggtttcttgaagatctgagtaggccgtgcgcgcgagtggacgtgttttggttttgctgccacgtttcatctcggctcctattttttctaatttggcctgtgagaatatcggcttttttccttcctgtgtttggatcgcttttaattaaaatattgtggaaaaaaaatatggcaaacatcgacttcaatcagctgaacggacgactgcggaagtgtttagatttcactttgagaattgcggcggattacagaggagcttcgaaagaggaatttgctgatggtctaggactgtaccacctacgaatttgtgcgaatttagggccattattctttattttatacgttaacgacatttccttcattctgaaaaaagtgaaagctctcatatatgctgatgacatgaaactgtttcttgaaatagtaaacgatgaagatatacatacttttcaaaatgaaattgatatgttttacaaatggtgcaataaaagccttcttcaattgaacgtgaaaaaatgtaattcaatatcctttagcagaaagcgtagtatacctaacacaacagtctacctatggaatcaactagtagcagggtgtctactacctggaaaaacctggaaaacctggaattatcagggaattttatccaacctggaaaaaacctggaattctcagggaatttcgatcacaatcagggaaattatgttggggcagtaaatcatgatataatatgttcacgattaaggtttttttttgcgtcaaaacccagagctaccataatttgccagaaaaatatattaaatcaaaaaaaaaattcggctgcgccgctatttgagctattcagtgaggctccttctgagtatgaaattttatcaacttaccaaagaaattttgtttttgtcaatatctctatactttatcggtaaaggattaacatatttagggttggtagcaaggtcctttttagagaccatttttatgcagatcttcaatttttttttgataaaagatctatggagcctctattttaatggtttcttaagttacttttttccttaccttaagtgcagataattattatgcaaaatgtcttctcacatttctcgagaacagcttcaggaattatcctagtgatttcttcagaggttctatctggaataataatatccggaactaatatagagatctctctagaaatccgtcaagaaattcatctaccaattctttcagcaatttttcaatcgatgcttacaggattttttccagaatttgcttcaggaaatccttgagcacttcaacgttactacttccagtaattttctcagagattattttgaataattttccaaagactttcctacaaattcctccagatattttttcacttaagttttgactttttccaattgtaactctaagatcttccaaacatttccaccgaacttctttcaagaaaacccgcgaaggttaattccagagttgttggtaaaattctgacgaaaaattctacgccatttcatctacggttattccaaagaattgttccaaaaatatatcgaggggttatgcgagtgaatccattaagaacatttcgaataattccttgaccttcgcgcttctgtagaattttctcgaccatttcatccaaggatttcttccaaacatttttcaatgaatttctcaaaaaatcccaatttgaaagtttatttaagatttcacatcagttaacactacagcatttttttttaaagaaatcgtccgatcattcctacacaattttttaggatttcgtcctatgttttccagaagttccttcaaagagacatgattcagagattcaattgatttttttccaatcaccttagcaataatcttgaaaatcttctgtgagagtgagtccttcttgaaatccttattcatcaaggatgacttaactgcccatactcgcataacagtcccatattaattttactcatttttgagttagctccgtgaatggtgtttatttttagtgtacttcccaaaatcatgcttaaaattgaatctttgtatggacaaaatgtggaaaaaataccaaaccatgtgcgtcccatattgagaatacccgcataacagtcccattagttgatcgtgacgaaattgaaacaaacaaattttgataatattttttgtaatcttgcgtcgtggttttcatttcattaaaagaatgaataatccaaactatactgattaaaaccatgttttttcacaaaaaatacttattctagcttgacatgaaagctttctagagtgacttctgttgcgataagttgtagaaacacaactaaaagtatatatctgtgcgaggcttaaaaacaagcaaaatagattccctttgaaacaaggtttggccaattgtcaacttatttggatacgaaatctcgaaacgaaatccccggcaggctcaagttttatcggtatgaaaagggaggcttatcgcgcacatcgccattagtatcatcgacagcattttcatagtcgtacggagtacctacatacctataacatctaatgccgaaaaatgatggttctgggcacacaacagtatcatccacatatgggaaatcgcaagtttaaagcgattgtcgtcataaggatccaaaacttgctctattagttatattcctcggtatggttcaagtccaacgtttctgtgctgtggatggtctcaaccaagctgccgatagaaacagataaatcaaatttttaacacaatcattgcataatgtagagtacctatattaatgtgtcaacgtgcgtgataacaaagtaagcgagtcctaaggaatgggactggtatccgggtatatttgcggttggctagagaagtactcggataacgagtaccattgacttgtgttctagctttggacttcaaaaacagccgttttaaccgtgttacagttgttgacgattttatgatattgtaatgatagtgtgtagagcaatgcactatggtccaggaatcagttttacgcggaaagatacattctgagctttagaatgaaacattagacaaaaacggtcttctacaaagttgtttgtattagttgagccctttgtttggtgttattgaaaattagggtggaccacattttcatagaaatgattaaaccaactttcttatttgtagaaattatattatacatgctccagcaaagctgtagaccattcaatttcaagcaactttgccaaaaaaagtttttttgtatctgttaaattgaccgatttaaagcttttttcctacggtgacatagggtggtccgaacgaaactggttttctggctctagagttttcaattcaagtttctcatcaaagtagtctatgaaacacttttagagctttaaaaaatgcgtaatttggtgagtgaagaaactcgctatctcctttcgtttaggagttattattgtttttcttccaaaaacatgcctactttgattatgaattcctctgattggggcaaacataaaaaatatcttttgacggcgttcaaaagacaaaataaaattgtatattatatcaaaaaaatacagatgtgttatttttgtaactctaataaaacgtcttgaaagtcaaacattttttatcacaaaaactttaataactcttgaactaaaatagatattaacaatctttttgcatgaaaatttgcgttttgttaagttctaaaagtcgttcataggcgactttgacgagaaaataatattaaaaaaactagagttaaaaaacttatttttgttggaccaccctgcgatgattaggaaaaaatgctctagattggtcaaattttgagctacagaaaaacttttttcggcaaagttgatcaaaatttcaagttctaccgctttgcctaagagcatatgccagtatttttgcaaataaaaaagttgattatatgatatgtgtgatattgtggaccaccctagtttcaaatgacatagtatgaaagcttacatttttagaaacaattttgtagaagatcatttttgtctaaaatttcattttcatgctcaaaatgtaaaataataaagaaatacataccatgaaaatcttcaaaatagttttagagccctatctttcttatttcagattttttgtcaaagcggtctatgaacgactttaagaacttaacaaaacgcaaatttccatgcaaaaatattgatgatatctattttagttcaaaagttattaaagtttttctgcttaaaaacctttgtttttcaaagcattttattagagttacaaaaataacacatctgtaattttttgatataatatacaattttattttgtcttttgaatgccgttaagagatattttttatgtttgccccaatcagagatattcacaatcaaagtaggcatgtttttgagagaaaaacaacaataactcctaaacgaaaggagatagcgagtttcttcactcacaaaattacgcattttttaaagctctaaaagtgtttcatagactactttgatgagaaatttgaattgaaaactctagagccagaaaaccagttttgttcggaccaccctatgtcactgcaggaaaaaagctctaaatcggttaatttaagagatacaaaaaaactttttttggcaaagttgcttgaaattgaatggtctataaatttgctgaagcatgtataatataatttttacaaataagaaagttagtcacacaatttctatgaaaatgtggtccaccctaattttcaataacaccaaacaaatggcttaactaatacaaacaactttgtagaagaccatttttgtctaatgtttcattctaaagctcaaaatgcatctttccgcgtaaaactgattcctggaccactgtgcaatgttaccacgatttattgctatcagtatgtttagaagcgtttttctcaacatgacgattttcctaatgggactgtattgcgagtatgggcatttaagaacatacacaagttttaacagaagttaccctaagatttgctttgggaataggtcatgaataatttttcaataatatctcagcgtcctggaaaattccattagctgttctttgtagaaaagtatggaaaactcctggaagaatgcttccatgaagaaatctgaacttccgtgagaaatctcctagtattattggaggaatactcagagaaatcttatagacaatctctggagttattcctgaagatatccttagaaaagtttatagttaaaatcttgaagaaattctgaagaagattgtacttctagaaaattctgagaaaaccttaaatacatctggataagttacaggaagaatattacaacatggattaaacgagaatcttggaggatgttctagaaaaatcgattggagaatctattttgaaataatcctggaggactaaaggatttcttggaaaatatctgtaataatatgtgaaggaattcctgatggaagccctgaggtatttttgtggcatttttattttgagatatccaaaacatttttttaggaagaattccttaggaaaattcttggagagttttttttttttgggaaataatcactaaatgaacacctacagaaaaatgaaaatctctcaattcaaggtatttatctatccatctaacatgaagaaattgtttgtcgttatgccaaagttttataaatattctcagagaaatgtccggtgttatcacactcttttctgctggttcttgttaggtttcgttttatgttttgattacagtttgatctattttcggtttctatttagtctcttttatcaggaaaaaggtttttaaatttccttttttcaagacattgagccgctaccagccctgctctatgcacatttttttaaaataattggatttaattggattaaaaaaaagaatgattctcgaaatataatctggaatttgaacaactttaaatttggaattacgttacaattatgattaatttaattaattcatcatttatctaaataaacacatttaaatgttatacagattggaagcgattaaccgggtgcttgatatccgtgtttttattatccgaaaaaatggaatcaagatccaaaagttttacggattatttgtattaatttagatgggaatcaaatatgttgtagataacttttgtaacaaaaaaaaaaaacaatcattaacacgattcaagcaatttaagatactactttctaaaagaagtatacagatgcacttgaaagtttcgttcagttcacgatgatgaacagagctcttacaaacgaaataaaagacaccatcattggcaaatacaattcatttgaataaaacttaataatagcttcagcatgctttaaaaatgtctagaagttatttaatctattaaatcaaaaacatttaaaatttgtcattagtttgtttaagccgtataatattagagcattagagtatttgaactgggaatttttttgtataacctagaaaaactctggaaatatcagggaatttaatttcagtgaacaagtagacaccctgagtagaaaaatgcgtaagaataagagatttaggagtgattttagattccaaagttacttttatagatcactataatacaattatcaacaaggcaaacaagatgttagcatttataaaacgatttagctataattttcacgatccatacactataaaaacattatacataacctatgtgcgttcaattttagaatactgtagcatagtttggtcaccattttcatcatcccatgaaaatcgtatagaatcagttcaaaaccaatttctgttgttcgcacctcgaaaattaggttggacaaggttacctctaccatcttatgaagcacgatgcatgctcattaatattcaaacattaaagaaacgtcgcgaatttgcaatggtttcgttcgtaaacgatatagtttcgcatcgtattgactcgatgacacttttatcaaaattaaatttttatgctccttcaagacaactgcgaagtcgtagtattttttatacaaaccatcaccgcacaaattatgccaaatttgatcctttaaatcaaataatgtctgtttacaataaacattgcgaaaccattgactttactatgacgaaatcggaactaaaacaaaaatttatgtcatatcaaaattcgaactagattaagaaaataacgttttcaaactatataatattaagtgtaaaattgtaacaaaatggtctacttctgattgacgacatgaaataaataaataaataaatgaaatgcttaatgctattgctaatgctaatgctaatgctaatgctaaataaatctatagccggttcttagggcattaagtctgagtggccacatccagtgcattctaaacggtgcaaacatctttatttataaaggtgaatatcagatcttaatgatttatgcaaattaaaatgattgccattgcaaataaataaagataacttgacgtgtcccaaaaagaagcccttttttacacgacctgacccagtgccccaccagaatatctctggccacgggaatatttccgagatcctttggcgacttttagaaactagatatgtgtaccagcatactgacaaaaaattatttgaatccgttaagtattcgctgcgcggtgagggttttagtattttgctttcactcaggcctatacgggttaaatctgaaaaagagaacattaactacaagtatggcggaattgatttgatttatgagctgaaatggtgtgatgaaaagcttcaggcagtaaatagcgtgttagaaggacgaaaggttccaaacgcaccgaatcaaaaattcaaataaaaaaattgtttacgttttgtttagaatcaaacgattaaaatcttttgctgaagacgaagaagatttgaactgcatagcagtgatagcaggttacctcgccacttacggaggtgaaagaggcagaatgaaaatttttaatgaaagcttaaggacgatgcgcgaagatatagtcggacaaaaattagataatccatcgaatgaacagatcgcgacagacgaatgagaatggtgaagagcacgttaatgagaaggatgatgatgtcgaattggaaggtgcggatatgagtgatggggataaagttaagaagctctcgaaggaaaacgcttaattgaaagaggtagtgaatcaaatgattcagcgtattcatgctttggaaacttctctaataacaaagccacataagccggagcaaataaagcggaatattactgcccataaaagcataactgtcccatatggaataagtaagcattgagaaaatagcgctcaaagtttaaagtttgttttctcatacaaattttcataattttctagtacatttctgcacgccttattcattttgcacagataactcattttgcttctattgatcagcaaaaaatataaacttttaacacaattcacgttttatatttggggccttccttagccgagtggttagagtccgcggctacaaagcaaagccatgctgaaggtgtctgggttcaattcccggtcggtccaggatcttttcgtaatggaaatttccttgacttccctgggcatagagtataatcgtacctgccacacaatatacgaatgcaaaaatggcaatttggcaaagaaagctctcagttaataactatggaagtgcttattagaacatttatctgagaagcagtcccaatgaggacgttaatgccaagaagtagaagaagacgttttacagttgtcgtttcggttgaatgttcatataaagactgttatgcctttatttttcaatattttgttatgctcttatttttccgcaacattttcaaataaagtgtgtaaatattgatatgcatagtaaagtatatattaaaccatacaagttgcgattgcgattgaaaatagatgttggttcgaaaatccatatgggacagttatgcttttatgggcagattagcacaccattagaaagaagatcgattcaaagtgagaatgagtccttggtgtgagaatgttgaaatacgttcaagaaaatcactcaatctcatttttgaagcgtttcttgtggactgatcagagttgggaaaagttctgagattcacactacgataggtaagcgtagtacatcacagtcagcgaagtcagtgaaactcacgtctattgctgctgtaggcaaaatgccttgaaaatagcaaaagactcgttgctaagagcaaacccaaaactactgtagaaaaatgttctattttctgctgcatttcccgcatttgcagccttcaatgacactactgatttgggaaattcatatacccaacataggctacttgagatgatgagattcacgattttgaactactgtggtgagagaagccacgtgattttcgcgaaattcaagcctactagagagctggatccaattattggcacttttgattcacttcggccttatttgcttcttattgcaacgtttcagaaaattcggccaagaaaaacccccatgccaaactgaatcatggaagtgcccaagtggttctgcaccctactattactattcccagccctgagaatgaagcgcgtgttaacgttaataaagagcaagatttgtatcaatgggtagaaacaaaatacggatcaattgagcgtgttgttgatagaagtagagtaccgcagcttgcacgttaatcaggaagttagtcaagcagcaacagtggaaaagccgcaaaacagtcgattaccattacataaatggtcgattagatacaatggttccttaaagaaattgaatttaatgcaaggtcggaaggttttacggtagcagaactgtttgtttctgcagaccacctttttacgcgtaaagctaggtatgctgttctgctcaagaaaagtaaaaaatggtcaagaaattttttacagcaagttccattttaattgatatttcttttcaactgcatactgcgatcaaaaaaatgcttttcttgattatttggtcggcgttaagtcagaggggaccaagtacaaaatttgggaaaattttattattctctcattagatgcgaaattaccttacctccgtatccctttgatcagattctaagagtgctgtaaactgcgagagatatgtaacatatttactttggatgatcaaaaaaatcgataaaagtgtgcagtcagagtggaccaagtgcttattaccatatcagcgaaaatgatcagcgcgctgtggaatgcgaggaaatgaaaaacatttcaagagatttgtcagatttctcgacatcgaataattgttttacttatccatcaacagaaaattattaatattacttaattcgatgcatttgattttgttttttgaccatttaccatatttggatgtgtggtcagaaattgcaacaatttctgtgcagacagagtggaccaagtgttaaaaagcaataaactgattgattattgctttattgccttcaatactctgaccctgcaaaactttaattttcaagctatcgtaatgccactgattacgatattgacgatatggattatttaaaaatttacgatactggtgtccaagggtcttgataatttgtttttcttagagatatgcacctagtttgaccatgcaagcattaaatgattgttatttttctagaaattcagtcagagtgaaccaactcactgaacggtggtctttagttcagtcagagtgggccaagtacacatagtccatcagaaaatcgttctatgagaggtttgaattgtgatttttcatgattatcgcttcacatcatattgtttgaaagtaacacgaagatgtgcagaaatattgaaccaaattttaaacgagtgcaaaaattacagagcgttagactttaaacccatttttctcaaaatgtgaaaaatgtcacttggtccactctgacttaacgtcgaccatttcttgcaagaaatttcccacgaatcgagataggcgtttacttttcttgtcagcagcaaatcagcctttatcagacgtatgcacttcaacagacgcagttgagaagaaatgtcatttcaatttaagctctctgtaggaaatttcttgacccattcaatcaaggaatttctttacttttcttgagcgaaacagcatacttagcttaaggctagatcgtggtttatggaacttaatggaaataacaaattgctaacatagataaatttggtaagagtaagtggcatctgtaaacattgactaccaatacgaacgtctaataaatgtgcgtagacaaggtccaagggagaaattccaggacttttatctggatatggttcatggatatttggatacatggacttttatctggatatgattcatggatatggtatgcaggagttttcttctttaggtgtaggcgtaatagccatcatcgttacgcacaactggtaccaaatatttttttactaaaatagttcccactggcaagtttacgctagaaaagagagtcggtttgagagagctaaatctgaaatagaagatattagtcaaaagtcacagtaccgggcaagaaataagccagaacataaatttcaacaaggatttaaatgaggatttttgtttcttcttggcattacgtcctcattggaacagagcctgcttgtcagcttagtgttcttatgagcactttctcagttattaactgagagctttctttgccaaagttaccattttcgcattcgcattcgtgtggcaggtacgattacactctatgctcagggaagtcaaggaaattttcattacgaaaagatcctggaccgaccgggaattgaacccagacaccttcagcatggctgtgctttgtagccgcggactctaaccactctgctgcttcttatcatatttttttacggagacgaaccagccacgggctgaaagtctcacaaataaagcaataataatcagtaatgaataagcttttgatatactaaacgaaacacgttacaaatccggagtgtagaactagccctcgtgcgttaaaatacactcaaataaagatttaaaaaaaaaaaaaaaaaaagttacaaatccggtggccaataatgaccacgtccaatcatgccaattttgtaaaaacattattatcatcccagaatacctattcttgaacatttttacagtccgacagcttctccaccccgatgggcactgttcaaccggatgacgatgatgttgagcctaaatacctgaagccaaagtcgaacaaggccgattcggatttcatgcgccagattgcttttatcaacggattgagcgacttgctagtgacctcgaccgatgagaatgtgccaaccgtacacgttgtccgtatgtcgtttgaagctatcctggctgcacatgaaccgtcctctcaggctgtgatggaagccaagaaactcctggccaatgctatgcaggaactgcaaactgcagcggataaggccttcgacggagccgttgttgttggattgatcacttctaccgaagctccgttgatccgctccaaacgacaggctgctgaaaccgaggatgataatccggtaagcttttgctgttgtgacgtattattctacacatttcctaattcttatatatttttctagttgaaccttgccctgaagtatgatagcaactacccagtgatcttcaacatcatcctgtggttcagcgtcattctggttttctcactgctggccatctcgatcgccattgccaccatggatccaggcagggactccatcatctacagaatgacttccaccaggatgaagaaggacaactaagcgtccatcaatcaacacattttacttcatcccccacatcggatagccaagcgatgagatctgtgtcattagcgtgtcacttgcgccctaaaaagtattagctcaacagtaaattatcgatcaagcagtgcaaatagcttctcttcttttgttccgttgtagtaaattaacctcgggaagtatttggaactacgtttgaatagagcgaacaaaactgtggttatcaattcatatctgttactgtgacttggcacgtagcagtttaagtaagtacaatttgtagggaagtgcagtaaattgattaaaatgtgttacacttcgcacaccaaatcgtatgttttcgttgttgtaattttgattttaattccaaaagtctaccgttaaataaagggaaacattccatcccagaaaaccaaaccaataaaaatgttacttattgtgtaaaatggtgatgacagaatcattcatttcttggcggcaaaatgaaagatattgaaactgcgattaccacttcagcacgtccttggagtagtagcatgaggccaaatccggccagaagattgttgggacgttgtgggccttcaggagaggaaacagccgcttctggaggcagttttttatgtacacctgtccgttcatcgtgtcctgggtcacgaaaggtgctctccgcttcccgcacgtgcagatggcttgccaaaccaggaatttcttcacaaatttggacatcttctgagtgcggatatgctgcggaacgctgaacttatccttggccgtgaaaacaggttgccggggatctgtttgaagtcggccttcacatatgttccgtcgtccatgatgcagcattcaactttcgtcagcatgttgaggtacaacttcctggcacgggttttggcggacttgttctgcttctcgtcgcgattaggggccttttgtaccttgaacgttcgaagcccagccttagttttggccttctggacaaaacttcggcttaggtgcaggttcttcgggatgtggctaccgaacggag

SEQ ID NO: 189 - DNA, 2277 bp, Aedes aegypti
acatacttgcggtaacaagatgaaaaaagtttatttatctaaatttggaaaaatcaatggtaggtattatttccttccctgtagtgttttaattattaagaaacaatcaaatattataggatacttttgctgccgtacacatcccgtatgcatgtcccggtgcacaaaatcgccaaaagtagctgcccatttactaggctagtaacatcaacgaaaacttatcaattatggtgaataatgattatttgtaaatatttgtcgaataaaactgatgtatatgttaaagttttttagttggtatttttataaacgagaaaaaaataataaaattagatagaattttcatatatggaaaaagggtaaattttactctgtttctcagaagaaatgttttggatataatgggtaaaattcactcgttgatctgacgtacaagctttactctttaatgagtaaaggccctttactctttttatgagttaaactagtttctctcaaaaagggtactttttaccatttaaagggtactttggtcttacagtgtaaaccctcttctgccagttaaacggaaattctagcactttcagtcacatttacactagctatcaaaattataaacacagaccgaactaaaaatttgcagttttcgaaagtgcttcaatttttttatcttatttggggtgcaactgcaaaattttcattaaattcaatcaaaataaccggaatcttgattctggaccatattaaaaacaataagttccttagcgagtcgtagattagcagtgaaccaggcaggtaagttccagtaccagttcgattttcctacgaatgatgtcatccaagtgaaatacgggttgcatccaaaatatttcagataaataagaatggaatcgttagacgtaatctcccagcgaatcgacaacttgaaccagttgctgggaccgctaccaacaaccgacgcccatggcgaaaacctcacggatgccgttctatcagcgacatcatttctcccttcggccagcaccggtcacctagcggatggaagtgcccgggacagcatcttgcaaacattccaacggaaggaagaactggaagcctatctagatcctgcctatctggacgagaaacaagacatcaaggccaaggaaacctacatcaacacgattgcgaacgacttggccgggaccttcgaaacactgcagaagataaaagccctggaaccgacgctgggagcggaatacttccgcaacttgccggacgttagcgaccagttgaaaaccatgaccatcggaacggtcgagcagaagcaggctaacgatctgctggaggagagtctggtcattgcgatgcagcgctacagtgagattcagtccgggatcaaggattcgctgaaagcgatgaacgatcggttggacatgctagagcagcggctggtcgatcgaaaaaaggaagataaggatatttaagaggggggcagatcgatttctagcggtagatgcattactatttatttatatcgatgcgagtatatatatgatatatattctttaactagattattctttccaaaataaaaaaaataccttgaaatatgaaagcttgaaattacgaattaataaattgaaaatctgcttcataggcataaatcatcagaagcatttatttatatggcagttagaaggccgttgtatgaaatcattaattgtttgatgacaataattccttacttctcacattctctctaaaactctacgctgaatgtgtattgaaacccctgtttaagaagtatatctggattagttgaattggtttttccaacacgacaaaatgctcgacctgtgggatttgcacttatgacccacagcttggtcttgctggaaaactgcacgtttatcgctacggctacagtcgcctctccacatctcgatatcgaagggaccatcgagatagggagagatcgagacaaagaatcaatttttgatgaatactagattgaaaaacactccgttgccaagaaagttatacacaaacaaacgtcattttgcgctcctaatttgttttgaatcccaaaactttggtctagtaaccttcgataatggtcatatcgacatacggagagaaaattgagaacgaaaaatcaacagaaacgcatcgagatatggagatatcgagataaggaggatatcgagatatggagagtgaaaatgtatgcagactgaagggacatatgaaaccatcgacatagggagagatatcgagatgtagaacatcgagacg

SEQ ID NO: 190 - DNA, 3011 bp, Aedes aegypti
atgattgtatgagccgtaacatcatgaggacacccacccacccccttcagcgttatgaattttgtgatcagccctttatgatcagcgttccagcctatggaccgatgcacgagttcactaatttgacgtttgagcggtgccgaattcactggtttccatggtcacataaataacacggcaccgctaaaacatcaaatagtgaacccgtgcattgatccatattgagaaaagggtttagggcccattcgcaaatttcaaaacgctgcagggggtgactgggtgtccttatgatgttacagctcatacaaaatttgtaaaattgtcatacaaaaagcgttacgagggtgttggtgtcaaaaatggccattttcagcgttatgaaatttgtgaatgaacccttataggacccttttggtcgatttcgcccaaaatttgaataaaatttaatgagcgtgcttgagttgttttcactgcttcatccatctatttcccatcggggccagtcgaacagtctccaaactagcgcggttgtcagtcagtgtagaattggcgtcgcgacgccgcccgccgccaactcgaaatgtcaccgagaaaaccctccactcgttcattacgttcgtgtacgctgaagcaagcaaattgtctcggctttggtgagtgtaattttctggtggaaaatcgtgtcaatttcctcaaaatgtggttgaatttgtgccgaaaatgtgtgcaatagtcggtagttattggagtttatcaaagatgcaaacatattttcgagttttagcagaaattcgatcaaaggcgtttgaggatgttttccacgtgttccgacattcaaaatggtggaagggatgtgaaattgttctcgtcactgatgtttgtatacttttccgatttcagttcttaaatttcttccggaagtccctatttaacattcaagatgggtagggaggacaaagctacctggaaagccaactatttcgttaagatcgtggtaagtagttgtttttacccggtgttccggatcttcccaaaattttggttgaatttagcgtccaattatgatgatggctagcaaagcattcggatattcggcttccttgcttgaataaagctgaacccaggaagtgttcggtattcggaaatggttaaactttcctcaagtctgaattgacgctaaacgtaacctcaatgtctgggttggattcgattgctgactgatggttaatccgtgcaatttccttcctgttttctagcaactgctcgatgagtaccccaagtgcttcatcgtcggtgccgacaacgtcggatcgcgccagatgcagaccatccgtatctcgctgcgtggaacggccgtcgtcctgatgggcaagaacaccatgatgcgcaaggctatccgtggccatctggaggagaactcgaacctggagaagctgctgccacacatcaagggcaacgttggcttcgtgttcaccaagggtgatctggttgaggtccgtgacaagctgatggaaagcaaggtccgtgctccggctcgtgctggtgctatcgctcccctggaggtcgtcattccggcccaaaacaccggtcttggacccgagaagacctctttcttccaggctctgtccatcccgaccaagatttccaagggtacgattgaaatcatcaacgatgtacccattctgaagccaggcgacaaagtcggtgcttccgaagccaccctgctcaacatgttgaacatctctccgttctcgtacggtctgcagattgagcaggtgtacgattccggttcgatcttctccccggacattctggacatcaagccggaagatctccgtgccaagttccaggctggagttgccaacttggctgccgtttcgctcgagattggatacccaactctggcttccgtgccgcacagcattgccaacggattccgcaacctgttggccatcgctgccgtcaccgaggttgagttcaaggaagccgaaaccgtcaaggagttcatcaaggacccaagcaagttcgctgccgttgctgccccggctgcttctgctgctgctgctgctccggccgccgctgccaaggaagccccgaaggaagagtccgaatccgaggatgacgacatgggcttcggtctgttcgattaagaagcgcgttcttgtctagccgccaccagtggttgcactgcaccatccttttctaatatctactcctcggggacggaaattcgcatctcttgaaaaggagggacccgtatctactcgtccgggattgaaacgacaaatcgattccaatggcgatgtacgtgggccgagtgaatttgaatttgtccccggaatacgtattgaggatgggcaagttctaactaaaaaatatggtattttgcaataaaatacgttaaaatgtaattatgctgttgccttattgttcttcattcagtgatttgtgaaactagcacctgtatgctcgtcagatttcaagtgtcatagcttgcgatttattttaggaaaattcctgtttttcatgtaatgtatgttcggcatggggcatcttcagtcacgttccaaatcgcatgggtatggcgagttttatattttttaaactcactgttttattttggtccaactagcatgtatacaatcataatacagtaaggacccgattttgtcagcccctcgatgaattttaggctgacaaaatagggaacctgacaaaatcgggtcattttattttgttcatatttttcaaattttgacgtgttatatggttacatggacttttaagagggcgatggatatgggagtagtcagtttttttgatcaggggctccccttcccttatattcgtaatatcgatttttaacacttaataaaaggcattgccattgccccctctggctacgcccatgcgtgcatgacatgaaacatcatcatcaattttaatgtaaacgtggtaaaacatgacgataacactttttttttacaaatttaaaataggctgacaaaatc

SEQ ID NO: 191 - DNA, 18160 bp, Aedes aegypti
caacatgaggcatgttcgtccaccggtgttgtgcggcatgatgcacccacaacacatagtgttacggttcatacaaaaattttaaatgttccatacaaaagctgttacgtgggggtgggagggggtctaaaactcacaaatttagcgttacgtaatatttgaatgaacccttaaatgatctcgcagcagatcaaaacaaaatcattgctcttgtgaagttgagtgttcggaatccgagaccgaacggtatactttgtgaaaaatttcctcccagagtaaatataagattaatataacaaataccttcgattgctttcgctttcgattatatctagatatttgccgattatgatttaaaaacatgcaaacttcaaacgttctttgacttcttgtatacatattttgcttttcaattagttgaataacaaataacttcgattgcttttgctatcgtccattttaataaatcagattctgagtaggaattttccaagatgtgtgaaccgttcaaaaattatttttacatcgcagttgtagcgtttcaatgaagcgccgcttcccgaaagaaatgtcatttcgtttcattttcacctcgttccgcttggatcgtctgtcaaagccagcgccatcatcgtccgtgcggtttttggtgaaaagcgaaagtttgcagacgcgtccttagcggtaaagaaaatttcaattaaaggtaggtaattcgtttcatttgtacctaattataagagaagattatagctcctgtagtcatcttcagtttgatgctaaaatttaatcgaagaggtttgattagaagagattattcccagtgaaaaagttggctgtagctgtaagtgctcatggcgttttcttccccactgcttattattcctcgtagaaagatgtagaaaattgattcccgttgtaaaatttgatgattttattttttagtgaacaatgggtgattccgatgatgagtacgaccggaagcgacgtgacaagttccgcggggaacgcagtgccggagaaagttacgctcggggtgccgacagggcggatcgctctcggggaagggacgaatgggccgaacggtgagttggttggcgtaagcttgcaaaatagtttcaaacggatgttccaaaaactttgcagtggtagacctcgacaggattatcgtgactatcggccaccgccacgggatcgaggctattctcccactcgcgagggacctcccatgaagcggatgcgcggcgatggctggggagatgacgcgcggccacgatttggaggtaggttgagggggtttttgattgtggttgtaagctatgtaaattcaaacattaatcttttaatctttgataccccttaatgggtatgaaaacattgattttcggtatatcaatacaaaatcatccaatgctaattgggagtgatctctaattgtggtttctctttttaggacacgaaccctacggcatgtatggcggatacaatcatgaccatttcggcatgcatccggcgggtccgtacggccatcccgggggcttacatccacgagaacagcaatccgcaggggacatgcaaactcagccctgtatgatgacgttgaagcagttcctggccacgcaagatgattccatttccgattcggaggcaatccagaagtacaacgactacaagctggagttcaagcggcaacaactgaacgagttctttgtggcccacaaggacgaggaatggtaagattcggcagcaaaatcgttgaaagtattttggtttgtgtgagatctgggctttcagaaggactgagtagccccgagaacccaacggatgaacccagctggcagaaaccaccgaacaccatctcgattctgctgccttgtttgtgtctagcaaatttaataacaattcttctccttgacagcgctaggtcgagcgcagctctcgagtccaacttgcgcctcttctgccatttgtctgttgtaagatgctatcgggtttaggagaactgtgcccttgacatcgtccccatgccgcgtgatttaaactcgagtaaagtatttcgcgcgtagtcttggttagggaaccctaggccccatattggacgtccggcgagcaatgccggacgttccgaattttagcgattttttttttcacattcgcgatttctcgaacacttcgtcaactccgcgcgctgtgatgaaatgcgaagaagagagaggtatttacatttcttaataatggtttacagcaagcaataacagattgagagaaatgtttaagtgttgttacacgttgcagcaatgccagctgacctaagatctatttgttacataaagcaggaaatacagtattttacagataagatttttgatacttattgttactgtttatcgatcatttttcaaagataggtcgtactgaaatcgtgtagttgtgaatttaactaatattgctttctttttcttttctcgtttgtaatttttcaatcgcatcgtctaggttcaagatgaaataccatccggaagagtcgctgaagcgaaaggaggaacaattcggattcttgaaggttagtattcaaaggcattttaacgatcaacgctccgtcatcgtaatcatcgtcatcatcgaaacttcaaaagcagtttttctgttcaaaactaaaaatgattcgatgaaaatgtgttcactgtgtttcgattggagaacagaaaacagtgaacacattttccagtaaattttcttcattttgaacggctttttaaaattccgaaatcaatgacggatcctgcccccttaacaggcttaagcatgatgagtctgctatattctgctagctttaaatgtaaagatgaattgaagccacacctcaaatcttcaagcgcattaaactggaaaaccattcaagctgaaacgattgatcacttatgacaaatcgaccaaattttaagtttgaaagactatctctaaccttcttcatctttgatttatctgcacctgaagtcgagatatttagttggctcaaattatatcattgtcgtggagattgataaaatcttagctaaatttttgggtttctctagaaattattggtagttcgctacagaaatcataggaaaatacctccaaactaaattgacgattacagtatggcccataaaaaaaatgcgaaaatcttcatatcatgtttaatggtaatttttccatagaaaatgtgaatgaaacataaatattattcattacttgtattgtttaatatatttagactcagtttttcgctttggacatgatttttatctgttactttcaccttaccagagaggaataggaagcataccttcaaattttatcatgcggacgtcgagttcaaaatctgtgtgattaaagcttctaaaacatcaacgatggcgtgagattcttcactggccttgtctccagcatacgcccatataaaatgatagaactggttcatacctggattattgaagacttaaacatattttcgaaaaaaaacggctcattttgaagagctttgattgaaccttcatataagtgtgataagcggcttcgttttgctctaaacctatgagctaatattgatataagttgtctctaaccgaaggaacaaatttcatcctcaaaaatctgttataagcctccgtatttattttttactaaactttaacaaaaaataaaggtatatcaaacctataagacgcaaatgccctcaaaactatgaccctggcaaaatattttattgtgaccatgaaaaacacgttctctaagaactactccatcctctgataccaaacaaactaaaatttataacaataaagtgtgatttttgaaggtggaaagtttatcaccagagtatacgacaatcagacgctgtttctagctttgggcggacaaaacctttgaacttctttgctttattatataatttaggacagtaagaaaaatatgacaaaaattgtcctagatagcgaagttatgttagaatatactttaatagccagaaattacattcactagcaagaacaatgaaaataacgcttgtggatactagattcacgttcaaacaattttcgcatttttttatgggccatactgtatattaagctgatcggtaatccaatacgcatggtttataaattaatggtccgaaggcggccaaaacctcaaaaatcaaagttgttttattcgaacagtaatatttttcccgacttccttaacacttctgtggttcaaatacaaagtttgaagcagattcattgaattttgaatcttatacagttccttgagtggaccgtggacatgatttttcaagaaaattaatgtttgcgatccatctttcacaagatatttatgaatttaaagcgagctcaagccgcaatggtatcttcagagaagttgtttgtatatacataaaatacacctgagttgaataaaaaatttcattaaattcatacaaagtgaattaaaggtaaaattgttcaaaaaacatttttttttatgaaagtacattagtagcccgcgaatgcccgcgatgagaataagttcattcgaaagctaaaaacaagagctttcaagtagggtacacattattttgcgcaaacttgcgatagaccactttcaacgcgtttgaaggtgtacggagtgcaattctaattaaataataataatcatgtgatacgctaggtcctataacacttccccgaataccatcatccccaaaaacctataccccgaaaaccattaccccgaatggtaaattaccccgaaaaccagttccccgaatgcgacacatccccgatgatgcacttcaagaaattcttcaacgagctcgcgaatttgagcctaaaattccatctttacatagaacgagtacgataagcgaggttttcctggcagtgttaaaataattgtcagcgtaataactactaacatttctatcagtaattttttattctttcaatcatcggctgttctttcgaggtagtataatgccagtgtgaacgttttaaccaatgattttcccttcttttaattataggctgttctttcgagttgtactgtttgagttaaagtttgagcgatagctgccaaaaaaatcgactgacacaattgtcttgagcgacatgcaaaattgactgtgacttcagacgggcgaccttgaaaataagctcctgcgttacttgtctgtattacatcttgtaggtattacaacttccaacaagagttttgtccttcttttaattatcggctattctttcaaaagttgccgttgtaaagtgattatcggcatcataattattaacgttttcattaatgatttgattattttatcatcggctgttctagcgatgcattttttaaatagttgtcagtataatagtctggtgccattccagaatatgttgaacatcaattatacattaccatctaataatataacgcttttgaaagaaggcggtagaggtctctaacattaatatgggaaaacgaaatcagtatcagcattattagcagttcgaaaaatgtagcaatgaatcagtgaacactgccatcctcacaaaattaagttcacgcctgtgaatgagattttggttctcacttgacccttaaagaatagctgttgattaaaagaataataaatctttgctaaaaagaacacgaattcaaataaaaatcaagtagtagattgtattccattatcacgctttttccaatacctaatacatgcactgtcacactttcgtagacccctcccccacccctaaatgatggacgtcattattggatgaccccttattaaatatcattgactaaagtatattttgaagtgttccctacttcgtcatatagaggaggagttttctacttccgaatctttagattctttttgtcatatacattagcgacaatttgatagacaatgacctccaacgaacaacagaagacgtgcttaacctgtactaattatttaaaaaaatgtatgatattgatttgtcgcatcttcattttgaattttttggggcaagaaaattcggggttatggtccattcggggaaatggcattcggggtaacggactattcggggtaatggatttcggggtacttgatcattcggggtattgactttcggggtgatggttttcgaggtaatggtattcggggaagtgttataggatcgatacgctagtacgtgcattgcaatcgcagtagccatgaattgcatcccgaaaaggaacgcaaaacttgatcctatcttcttcgtcatcttctttctggcgttacgtctcaactgggacaaagcctgcttctaagcagacagatgttcttatgagcacttccgcagttattcactgaggactttctttgccgattgaccatttttgcatgtgtaggggcaatgggggcaatatgaacatacggggcaatatgagccaccccggttttgacctcaaaaacagtgttttaatgtctagtgtcattatgatctgctaaaggatgcctcaaatagccaccacaataaaaaccgtaagaatattcatttgaacactcaagatatttacaaaaatgtacaaatttgttcttcgtcatgaaatgcttataattttggcagtttttaattaagcctataagacaattatatttataattctggtaaattttaccaatccattgaaacttctaatcataatgaacagttcgtgagcgaaattagatttgttcttgaacaaaattattgtaaaacaatatattattttcaagatgaaggggcggggcaaaatgaaccacctgaatttaagcaaaacaaacgatgtttgggacataaaaatgcattgcctaaatataccagaatatttttttactgcacagtcatctttatgcaccattacaagtggaacactttgctagaaaatacgttgaaccaagtatcgcaatttagaactagtataacatggtctgtttattatgtattatgtatcgttaaaaaataagccgccagaatcaataatttcaagcaaagctaatacaatttcctttccaataatgtactcttcacaactaactcttctctaaactgtttcaaataaaaatcattcgattgaatgaggttactcatactgccccgtaaggtggctcataatgccccatatggttggtgaccacgtagaaaaacatggttttccaaaaagttcctgacataatttgcaagttgatgttaacattaattatcgacgtaacatggaagataacattttatagtaccttggtacaagttacttgcatttaaaccatatttattgctgtttttctatgcgttccatgacgttttccttaggcggcccatattgccccgatcacccctatatcgtgtggcaggtacgatgatactctatcactggcaagtcgagaaaattcactttaccaaaagaccctcgactggtgggattcgaccccaccagtcgagggttggtctagctgaatagctgcgcgtttaccgctaggactctctgggcccctatgtacatatacaatattttggtgttaaaccttaattaaatattgtcaacaccttcatttgatattattaggatattgaagtattttgaattcaaatttgaattgtcattaaataatataacacaaattatctcggcttatcaagatggttgaacgaaactatttgcttcggcatgcagcctacagataaaatgaaacaaattggaaaaaatcattccctgcgtggacttgcttttgctgttaaaataagtatgataacagattgaagctatagacatgataatcataatgaaactgattaattggatgatacttgcattaaggcagggtttgatctgaaatatttatggataaatgtgcgttcaattttcacatttttttttcagacatcacatgaatttcaacatatatttttgagtgattttttcaatcacgagttcatcatagtgatttattttacaaatttgataaaatggcgtattaaataaagaaggttgacatttagacaagatgaacatatttacttatgatggttttgtgtagagcttccatatctttggaagaatagtttaaattttttgtcaaaaaaaattttcaaaaataaactttagtctagttgtttttactattggagttgtgcatggaaaaattactcgaaaccaaaattcaagtaatgcctgacatgctgtaaaaatttcatttcaatccgtcaataaataactgagaactagccggcccaagttgaccctttttgtatgaaagattgaaaaagttgaaaatgtattgtccaaacctgaatattctaattataagtccaaaacaagaaaacattgataataaaagtccgtcatggttcaatatagcataaaatatgtcaaatatatgattccagctattttaatgaaagtttgaggttttggccgacatttgttctaaatcgaaccactgtgcggtggtccgcggagcactaggaaaccgtgacgacttctcagggcggtaattgtgtcatttttcatgattgttaaacaaatgcaagaaatctctatcgtttttttgcatagagaattagaagcggggttcagattttgtatattgcaaatattaaaaaaatggacttgttcaatttttatgtatacaattactgatcaatatctgcaatgtttttctaccagtaagacgttaaaatcccaagtttaactcactgattttacatgcttttttttcaagtgtgacaacaaacctaatctcgttcctagaagtatccataggaaatttgtgacataattttggcttaatcttcttcttcttggcaatacgtccccactgggacagtgcctgcttctcgaacccagacaccttcagcatggctttacttagtagtcgcggactctaaccactcggctaaggaaggctccaacctaggcttaatcattggcaggatttctctgtttcttaataatcaaactaatcttttcgaacttgtttcgaactagttagcataaattgagtgagatttctgacgtatatttgccctagtgatactatatagatttctgcaaagattctcgatctgacaagacttttgaagaattcatggcgaaattttaacgaacgcctgtaacaacctccagttggcttttttaaagttttttgcaagtttatgacattattccaagtagcttgcatgtaagacacctaacctttgtttgggaaattcttggcaaaaatttcgaaaattatgatggaaagcttgaaggaatttttcaaatctagtgaaaatcgtttggatttcgaactgaacttcgttgtactgttgtgaatcttttcaacaagccagcaaaattttttgttgggagcatctaatttacctgattttctgttgattttgacaagatcctactcagaagtttattattgaactcttagaaagatatctagtaaactcttggcaaaatttttatttaatttagaggactgatgattttagcagtagcattgaattatctgtttgtacacacgtatgataatttgtagagttctctgtatttatcctaagtaggtgatcacttaatctcacttttctattcgtcagattttgcaaggacttagtcagttgatgtgtcaatcttgtgtgagcgtcaggggttagtcccaaatcgcttccgttactaatcccaaattagtaacggaagggaagggggaaactttcattcatcattctaaaaacttactacttacgaatttatgcgaattgcttagttgctgttttcaataaattatggacgttggcacacccaaagccatccaagagtatcagctggtttataatgagatctttggaaggattccataaacttttatttcgagaccatccattttagcgatccgcaggaagttcgtagaacttcaaaggggatcgcagctgcaaaaatgttgagaaccactgccctaaactaacacaattgctaaattttacaaggtattcgattaaagccatcggctgcaatccacatgaaaatcttaagacattttggcaattttgacagttttctcccagaattaatgtatcctaccgaggacaattgctccattttgactagtaggggaattcgggcataatggacacatcaagcaaattcttgttttaagaccatacaacgacattttttttcaaattactcccggcttgttttaaagtttgatattagtacgacgtgctacattcattcatggtaataaaaatcatatcatatgccagaaaagtgagatagaaaattaggttcaaaacaaggctagtaaaaaggcaaaatgaacacttgtatgaaatttaatgattccaaaatatttaatgtctgtcagtcgttccgatgtgtaaaagggcactccctcatcataagagctgaaaagaacctttctgggttcgttattttgctcaaaacttatgaacttttgatgaagtatgcatattctcagagattgaggggatgtccatttcgccccgggtgttcattatgccccgggtgttcattatgcccctaatccccctaccttgttagactggcattacttcctatccatagcaatttatctcagcaaaatcgcgatcgcttgtcaattttcgaacacaaataacagtagaaagagagaagtagcacggcttgagaacattcataatattgataacagtttttcataactcaacatttcaactgagaaggcgtattttactgtcaatatcagacgatttggtcgacatgatgagacaacaaaattgtcgaaaatgtacaagttcctccacaattgttctattttagttcctgtttaatgaaataaaaaatgtcagaaccctcttgattctgcaagttttctagtgattctcacggaaatttctcttgcgatttctcaagaattgattacccaagtaactactagcccgttaatacgtatttttgggtttatgaggctatgatacggcttataaaggacatatcactttatcagcatgcagagtgaatcaaaccgacatttgggtatttggatagcgaaattcttcgggatatcccaagtttatattttttgtaattttctcattgattgcttcaaaaatttatcccaaaaaattttctagagatttcattcttctaccatattttcaatatcaacagaaattcttaaaaaaaaaaacaagaattcctccaggagttctcagtagtattttttgtttcctattttctccggattcgtttcggaattgctccaaaaatgtctctagagttctttcgagaaatcatccagaaaccttttttaacttaagtaattacttcccagggaagttcctcaaaaatatctcaataaattcgttcaggactttctcatgctgtacccccaggtattccatacagaactacctagaaattttcaaaatttcatccacggtatgcttttgctgtaggctattctaaattttcccgagtaaactttccatggatttggcaaacagttcatttactcacggtttccaccagaaatagctataataataattctaataatatctcaaattattcctttacacatctatttttaaattcttcccaaagtacttcttttcttgggttccttcagggtattgtttggtgtttttttctccaataatcatttcagcaatttacaatctatcaagatgatccaacagttttccaaggattaataattatcttcagagagtatttaaggattttcttaataatacttcgcggatcaattcatttttttttttcaataaggtcgattattacccccctttacgactacttgaaggcccatgggacaaaaagacaaaaaaatatttgtattgggtcttattgtaggagaaattccgtgacaatttcctgaagggattttttttgtaatttaatgaaggaaccttgaaaggaagcttagaaggaatctctgggataattcctggaggttctttgtgtaatctttgagaaatactgaacgaagattgaggaaattaatgtaagaatctccctaagaaaacctgaacgaatattacgagagaatttctatggaaatctgaaaccgatgtctcgtctagtatgagacctatgttgtgtttcatttatggacaccgaactatgatagcagtggacaactactgcctttcactaatttaacttttttacgcgtcatcgaaaggcagaactcctgctcggtggggaacgatattttcactagatgaattcctgaacaaatcatgaagtgacatctgattcattttggcaaattgatttaccattgatcaaattcctgtaaaaaacatagattattacctggcaaaacgcacatctatttcttagaagtgcttgctgagaaaagtttggttggattctctgatgactcattaaaaaattattataaaattactcttgaaggaccaattccctgacgttcaaacgctactaggacaaatcaaaacttttcttcaatagagtttcaaagctctgtcccaattttagtaccaaaagcttaagttcagggtagagcgcatcttgcttaatttatgatctcaccctaaaagccattgcaaaccaagtgtgtagctttttgtttctgaacgatggaatggatttacacattattcagcaatgcggaaatgaaaagatgatcctcttctacctcccagtggtgatagttagatagactaaaataaagtcaatcaattttcctaaaacatcgagctacacactccgttaccaatggctttaaggaagaggttacaagttatgcaagacatgtttacgcattgtttttcgttggtttaagtccaaaaaagtttttggagatttcactacaccccttaaactcaaatttttggtgttattttgttttccgtgttccttccgaaatgttaagtgggaatgaccccagtgttaaaaagtggatcccatgcggcgtttttcccaactaatgaacgttaaacatgatcaaaagtgtcaaggttcaaagttacacccattttttcaattaaatgttgagtatgatataggagtttacacattatcaacagtctaagccgatgtcgctatttttttttgtaatttgatcagtcagacgcatacaaattacgtgtgactattgtcggcagcctcgttttcttcggtagccattccataagaagtgcaagcaactctcttgggcattttcaaatcagccgcaatttgatgcgtatttatttcaattattgatttctctggcgaaattgtttattcagtctcgaaaatctcatcaggggaagctgacagagcaaggaatcatctgaatattttcactggtatgtttgatagaaaaatattgtgaatttcgcgtttgaaatttgactgccgataagagtcagatggtgccgaagccgtaaattaccctagtcgttatttgagcgggaaaatttgggggaggaaaaaagatctgggagttacctttggtcggtgatgcgatccatggataacaaggtaaaatacaacagttgtagttcaaaactaattttgaatttttatcggtgcggtgaaaataggaagctagattggtagaatattaaaaaagttcgtctacattcatgatgtcgaaccattcaaaggttattttgagttatgatgaaaaaagagtggtacatgtacattaaaacaatataaaacatgaataatggttaatttggacacttgtagtgacgaaccactcatagtctatctaaaatttacacaagcgtaacgttaccaggataaaaatgtgatatcataagcatggaacgagctcacctgttagcaatcaatcctcgattgaacacgaatatcttttcgctctcgcaccacgcgaaccgaacaagattggtctttattccgtcgctcaccctacaggagcaggcaacagaatcgaaataccacactctactccctattgttcttcatttgcaatagataactaactgttccatcttagtaaaattactacttttatggaacatttaacacaaccattaatctctaaatatatctttagtgagttccacattaggtaccgataacctactcaaacgaacaaaaactaattatctgtacaatgttcctcccttttccacttgcagcgccgttgtgacgtgttcgttgaactgctggatcacggggacatctccaaggtctcggtggacacctccaacacggatccgttgcttcgcctgttggacaccgtggtgatcaagctggagggcggcaccgatgaggatcttaaagtcctggacgaaaagccggtcgaaatcgtgaaaatcttgccggagaagcccaaggtggaggtgaagaaggaacccactctggaggacaccatcaagaaggagaagatcagcatcaaggaggagaaggtggaagaggctgacaagcccaaggaggaaaaggatgacgataaagaaaaacccgcggcagaaggtgaggagccagagggtgaaaagaatgacgccgagaaggaagtgactgcggaacgggaagatatggacgcggaaccggcggctaaggaacccgagccggaggaggaaccttcgaggaaaaaggatcgcagaaaacgaagtcgatcggactccggaagcagttcgtcttcttcatcgtcttccagctcgagcgattccgaagatgagaaagagaaggaaaaggaagacaaagaggaagaggaggaaaagaaggagaccgaagaagaggcggctcccaagagtcccaaaccagtcgaagaaggagaaaaagaacctcaagaggaggtggagaataacggacataaaagtggtgatgaagaggaagcaaccaagaaagaccaagctgaaccagagaaaatggataccgatgaagctgtcgttgaaaacaacaaagaaagcgaggaagctgagaaggaaaaggatacaagtaaagatgaagaggaagctaataaagagagcaatgaggataagcaagagtcggaaaagacggaaacgatcgatctggtcaaggataccactgttggaaatagccctcgagcgttgcatcgcaccagttcaatctttttgcgcaacttggctccatcaatcacaaaggcggaagttgaagccatgtgcaaacgttacaatggtttcctacgagttgcaattgcggatcccctactggagagaaggtggttccgccgcggatgggttaccttccggcgcgacgtgaacatcaaagagatttgttggaatctcaacaatattcgcctgagggattgtgaattgggggctattgtgaacaaggatcttagtagaagggtacgtcctgtcaatggattgacctgccacaagacgattgtgcgtagcgacatcaagctatgcgctaagattgctcacaacttggacgataaggttggattgtggaaggaacaagaggataacggagagaagaatggagaatcgttcggtttgcaatcgaagaatcctgttctacaaaacatcactgactatctgatcgaggaagcttcggctgaggaggatgagttgctgggactctcgacggaagccgccaagaagtctaacgacggtgaactggtcgaacgtgacacgcagcttattgaggttctggacaaactgattctttatctacgcgtggtccattcaattgacttttacaatcattgcgagtatccctatgaagacgagatgcccaaccgttgcggtattatccatgccagaggtcctccccctcagaacaaagttacttccaacgaaatccaggagtacattcggacattcgagggcaagatggggtcgtttttggcacgagctgtcgatctcgaggaggaagagatgaagaaactcggcgccaaggacgccgaagccgaagtggaaaagttcatccaggcaaacacgcaagaactggccaaggataagtggctctgtccgctgtcaggaaagaaattcaaggggccggactttgtgcgcaagcacatttttaacaagcacaatgaaaaggtcgacgaagttcgcaaagaggtagaatatttcaacaattatctgaaggacaccaagcggccgcaattacccgaacatccgggtaacaccaagaaggcaccttccgatgcagctccaccaactgctgggtaagcttattttaaaattgatttgtggtaaacgtggatgataatatttccttttcataggtatcgccccccgtacggaatggcccatgcttatgctccgatgtacgctccttatgcccaaccgatgatggccccggcaggtcgtgccaggcccggctttggacgtggcggaaggtgagttccgatgttagtcttcctaccttttagtagatggttgttaaatagtgtctttcttatgtgtgtaaatgtaccgatcctttctcagtagtttttagtttgctccttgaatttgactgcactgcattacttcaatataaatttctgaattgtacaattttctctttcgttgggtggtttgtcactatatcgtcgtaatgttccgatcttaaacagaaatcattttgtttcacagaattcaagacgctcgacggaacatacagaatcgtttgaggtaagttgagggaatgaagtcggaaaagttaatagtgcagttcgtcgcgattccaattggtacatttacacactgcctgccccttttggattgttagaatagtagtttcaaggtgtctctccgatgtgaatccgatccgtgagtgttttgttccacagcttttctctagccgctttatttgtttcttggaactacttctctaatagtcccgccgttgtctccatcgaatagtcagagtatagaaacccactccgcccggaattgattatttattcggttgccatttttcacagagaaccaatgggagaaattcgacggccaattatagcgtacagcgatttggacatgcccaattttagcgattctttcctgtagttggaaagataggattaggaccgtttgccccccgacggagcatagtaatgacatcttcagtcaaatgacgagttttattttttttttgtttaacacgcaacgttgttatagacctaggcaaaacggatcgtcaataaaaattccatcaaccatatcgtcggtttggttgttctttactagagaaaagctcgcagaacaatgttgtgttttatgtgtacttattacctatctcggaaacactattacctattcaccggtattatcattcataacacaccgtcgttacattatgatttgtaacttttcagaatggcaccagattaccgtccagtgattcactaccgggatctggatgcgccccgtgaaccggatgagttcatctaaaccgtataaaaaaataaaacgatatgcaattgacacagtaacgctcagttgtagataagcccaatcgatagcattcacagtaatcaattagtaattgttcgcataccctatcacaaaattgcatttcatcctagatccgatacctagttgaatagtgtgaaataaaagacaaaaaacggcaatcattaagttatgttttgcatccgaaataccttgttctgtaaaatccatagcaagaattagggtagaattagtatattagccaagcagcttcacaaaattgatatttacatcgatttgttttgactccttgatgatccagggtgtctactcatttacagaattgaaattccctgagatttccaggtttttccaggtaaaaaaatccaggttgtacactccaacctctttttacgaccgtttttttaccgacggttctttttccgaccacttttttacgaccgaaattcagattaacgaccgtttttataaatgatcattatcttgaaaagtattcaaaatagaggatcaagatgttcagcaaaattgttcagtagttcaagggctaacatatggtggtcattcaattgcggaattctgccactaggtggcgctagtgagcatagaacttttgttttgcggatagctcaggatcctgaccacttagagagatggcgtcttcgacaaagttgttcagtagctcaatgactatcattataaacgctatgaggttcaaaattttgccacctggcggcgctagtgagcatgaaacttttgttttg

SEQ ID NO: 192 - DNA, 17162 bp, Aedes aegypti
gcgtggatcagaaccgaggatggagagatgcggccacgaaccgagtaccgtacaaccccgttaatttgaacggtacatcatgcaaaccatcggggttcatttttaatttgaacatctagtcaccctgaaaacgtgtatctggttacctcttttactgttttgttttgattctgcgttccgttccacagcgtgccatctcacttcactccgttccacgagctaaatgacgtttgaaccatttttaatcagaacggtgtgcaaattagcggggtacaaattaaagtgttcagattaaatgcggtcaaaccaacgggggtacccggtattgtggcgtgaaattgttgattcagtgttatgtgtttaggtagatgttaaataaaccaatgaaatgaatggggaaactaaaaagcttgttgcatttagacaccaatccgtctcattaaatgccgtttccgtatgaggaaaacaaacaaaaatatcccatttttgatcttgttgctggaaaggctggcacacctttctataacaatcttgaaccgccccccgatttcattcccagcatcatcccctcagtgggcaaccattccgcaggttgacagccgacgtcatctcaaccgcacagggccgtgcaagaaaactgcgggaaactgcaataattacacatcaacagctcgctcgactggcagactgcaaacgagacgtcgtcggacacggaattttgctcttcgagtcttgagtgctatcgcctgctggaaggagaaagtctggctcccgtttgaaacagagggttttccccagtaattcacgtgcaattccggacattctggccgggaagggatttccggctccgtgcgcttcgctggtggtaggttttgtttggggcattttgtgcaattcgagagagaaacgagtgcttcactaatgattgtgtgtttcttcttttcttgggcttccgatggtggcgatttggacacgactccgaaaaaaagtgagaaagattgtgaaacgattcgggcttgagagtggtgggatcagatctgagtcaaggacgaataatacagccagtgtgtttaaaaggagaagttgccacacaagaggacaatcatgaacataccgaaccaatatctggagaagactgaagacgttgcggaccaggtgagttaggggagagtggggcgaagaagcgtcgcaatgagggagggtttaaaggtcagcgggttgtggcggcgacggctcgacgaaatgcaaaatattcgcctcaaaaaacatcaagaggcagagctgccagaccaggcggagaagggatcttcaagagagtgctcaaaacccgaattaaacgaaaacgaaacatgaaaagtgaaagttcgaggtcgtttgttagattcttgttttaaagtctggatggggagtgtaggtttagataactggtttatgaagtttgattcgacatcgtcattttttacgatgacttaactgataatattcttctcattggcattacgtcctcactgggacagagccagcttctcagcttagtgttcttatgagcacttccacagttattaactgagagctttctttgccgaagttgccatgctcgcattcgtatatcgtgtggcaggtacgattatactctatgcccagggaactgaaggaaattttcattacaagatcctggaccgatcaggaatcgaacccagacatcatcagcatggctttgctttgtagccacggactctaaccactcggctaagaaaggtccctaggggcccagatagccgtagtggtaaacgcgcagctattcagcatgaccatgctgagggtcgtgggttcgaatcccgctggtcgaggatcttttcgtaaaggacattttctcgattcccagggcataaagtatcttcgtacctgccacacgatatacacatgcaaaaatggtcaatcggcaaagaaagctctcagttaataactgtggaagtgctcataagaacactaatctgagaagcaggctttgtcccagatgggacgtaacgccaaaaagaagaagaagaagaaaggcccctaactgataatctacttagtagggtcgatgtaccaatagccgcatagctaagaacaaatattcgtataaaatcgaaaaataacgctacagcgtcattatttttacatcatctgaaaccttttatcttggtgttgtgggaaaaaatatgaaaactatgaaaactcatatgtttgtatttattatcgcttgtgccactataggaatacatgtgcctatagtagcactatttctaatttctgttcctataatgcccataaaagcataactgtcccatatggattttcgaaccaacaccttttttcgtctcaacatttatgttttaatgtatactttactgtgcatataaaaattaacatactttgtttgaaaaggtggtagaaaaatatgtagcccatattgaaaaataaaggcataacagtctaacatcacggcgttggcaaaatgctaatcaaaaccgtaattttacaaaacttttatatttttcctacaaagtatgtgtcaaaagctttcgtttgatgtaaaaatagttcctaatttatcaattatttcgtataataaaaaatagtttctctcagtagtgcttctataggaacaataggtttactataggcgcaagggagcttaaattttaagcaaaactaataatttcgataatttttgaacaaaatcaagctgtgtatcaatggtacttagataaacagctcctgaccttcatgtcaaaaaatgttttgaaaagatttatagcaaaacggccgtaaaaagccactagtgcgactacaggggactgtccactaaaggaacaccgaccctagatttaacttcttcgttgcagtttgaaattttgtcgaggtcagatattatgcgatataaatatgatatctgcgtttttcttaaaagacaagagagagaatctcctatttgtacataggtcctttagtaatgttcagcgagaattattcttggttcggccgaggactttctcaacattttgtagttttttttaataggggtgattggggtattatgagccacctaaaaacagtacatttttttccactggagagcggggtgtcaaaaaaaccaaaaccgacaaaattattgacattttcgcgtctcctctaggcgaaaaaaatgaacaatcctcaatgcatatttggctgtcgagagcgagatgtggtactgttcctaaaagcacaagtgaatatgtatatcagtggttctcaacctttttgtagccgtgatcccctttagagctttacatacgtctcgcaacccctagggctcattcatttgtggtggcaacactgccaccgttgatgtatgaaatcagttagagtgacgcaataaacgtgtcgtgttgttattctgtactcgtcgcagtctttattatctttaccgtccgaagtaatccggaaccaccgaaatccccatattggtgaccgccgacggtgaaagtatcgaattcgcgttaaatacggagtgaaaacaagtgctaaacatgaccgaaaatcagcagctacaaatcgtcaacaatcagccacagccagcagcagccgctgcagttgctgtcaaattgccggaattttggaagtcggacccggcaatgtggttcgcacaggcggaggcacaatttgccttggccggaatcacacaggacgtcacgatgtttcaccacattgtggcaaaaattgatcagtccgtgatatgccacgtcacggatctggtgaaaaatcctccggctgctgacaagtatgctgccattaaacttcgactaatttcccgctttgaattgacgccacagtcacgcctcgaacgtctactgaacacttgcgatcttggcgatttacggccaactcatttgttggcaaagatgcaggagctatcagcaggcttgaacgtagatgaatctctgctaaagatgctgtttctacaacgccttccagccaacatccgcgccgtcttaagcatccacgatggaacactggcaaaaattgcggaaatgggtgacaaaatgatcgacttgtccccaccagcagcagctgccatcaatgttcgaccagcaccatcgtccaacgaagatccgtattcacaggagagtctggcaaaccaaatcgcagcattgaccgctgaaatccgccagatgaaagctaaaccacaacgtcgctcccggtcaacctctcggaatcgtcaagcatctggtgtaaataacgtatgctggtaccatcgcaagtttggcgataatgcagagcaatgccgcagtccatgcaattatcaagcgacaaaaaactaggcaaccgcccacctacagtgaatgaggtgggcggaaaccagttgagccgccgtcttcgcatttttgatcgcacttcccatatccgatttctcatagacacaggatcggatgtttcgattattccagcaagtaccagagaaaaactccacggcccctccgccttccagctacacgctgcaaatggatccacgatcaaaacgtacggaaatcgttttgttaccacggatctagggctgcgtcgccgattcgcatggaatttcctagtcgccgatgtaaccactgctataattggtgccgattttttggcctatttcggcattctagtagacctcggaaccaatcggcttattgacgggaaaacgaaactgcattccactggcggaattgcacaagccacggtacatggtgtgaccacgatcgatttcaatcatccttttcgcgatttgctgattgaataccgcgagattaccacaccaccaactatgcgatccgaaattcaacacaatgtgacccatcacatccaaacgaaaggtcctccggtggcttgtaaaccacgcagaatggcgccagataaactgagggcggcaaaaaaggagttcgagatgatgtcggagattggaaaatgccgtccatcgaaaagctgttgggcgagtcccttgcactgcgtccgtaaaaagaatggagagtggcgtttcgtgggggactaccgaagcttgaatcgtgtcactattcccgatcggtatccggttcctcacatccatgaccttttaaacaattttttgggtaaaaagtacttcacaaccctggacatggtacgagcttattacaatgttccagttgaagaatgtgatataccaaaaacagccgtgattaccccatttggactgttcgaatttacgagaatgcaattcgggctatgcaacgccagccagtccttccaacgattcatgcatagcatcttcggagatttggactttgtaattgtttttgtcgacgatatttgcgttgcttccgctaccgaagaggagcatcaactgcacgttcggatagtcttcgatcgattacggaaaaatggactcgtgttgaatctcaccaaatgcaaatttgcacaaacggaagtagatttcttgggataccgtgtgaatgcagaaggtgtgaaaccagaaccagaaagggtgtctgcagttactgaatacactcaacccaacacagttaaggaattaaggcgtttcctagctctggtgaacggctacaagcgttttcttcctggtgccgctgaaatacaaaaagttctacaagaaatgatcaacgggaatcgcaaaaatgatacacgaaagttgaaatgggactcagcaacaaaagcggcgttcgagaaatgtaaacaaagcctggcaaaagcgacattattgcattatccggatagttcaaaaccattggcattaatggtcgacgcttcagatatagctgcgggggcggtactacagcagtactccaatggcatttggcaacctctaggcttcttctcgcaaaaattttccgcttctcaaaagaaatattcagtttttggtcgagagctgacggcgatgaaactcgccgtgaaatatttccgccatctgattgaaggtaagaatttcactattttcaccgaccaccgacctctcacttatgctcttgactcaaactccacacacttgccccatgaagaacgttacttgcagtatatctcaagctttacaaggtctattaaacacataagtggaaaggacaattttgtggcagatgccctatctagagtgaacttaatagctctaccatccgttttgaacttcgaagatgtcgctgtagaccaaacgacagactcggaattgcaaaaactgctaacgagcaaaacatcctcacttcgattagaagccaagagcatcggccagtcatctaagcaaatatattgcgatatttcaggacccggacaaccacgaccatttattccgaaacttcatcgttcgagtatcatgcatgctatacacgatttgtctcatcctggaattcgtacaactcggaagctcgtatcctccaagttcgtgtggccatcgatgaacaaggatgtttcccaattcgttagatcgtgcgaccgatgccagcgctccaaaatcaaccgtcacactcaagcagcctacgggaatttcgatgttcctcgtggaaggtttagtcatgttcatatcgacctggttggacctctaccaccttctaatggacatcgatatctcctcactatggtagacaggtttagtcgttggcctgaagcagtaccgctaccggacatgttagccgaaaccgtagcaaaagccttttgcaatacatgggtgtcacgtttcggcgttcctgaaacaataagtactgatcaaggtcggcaattcgagtcgcaattgttccacgaattgacttcatggctcggaacgacacgtagccgcaccactgcttatcatccacaagcaaatggactagtggagcgattccatcgcactctgaagtcagcaatcatgtgtgttgatccactgcattggagtgataagctacctatgattttgctcggactacgcaccgctattcgagatgattcgaactgttccgtagctgaaatggtttatggacaacctctccgtattcctggcgattttcttgagcacagtacaactgaagttgaccgttcggatttaattaaatcgattcgcgatgtggtacaaaatctaaaaccgattgagagagtcaaccactcaaagcaacgtgtatttgtaccaaatgatcttcaaagctgtaaaggagtttttgtcagaatcgacacagttaagaaaccattacaacacccctatgaaggacccttcgaggtaattgaacggggagataagaacatggttatattgatgaaagggaagaagcaacgggtatctatcgacaggctcaagccagcatactcgtgtaatcaacaactagattcctgctcagacacaaagacgaaagttacgccatcaggccatcgcgttagattcttggcataactggtggagggtagtgtggtggcaacactgccaccgttgatgtatgaaatcagttagagtgacgcaataaacgtgtcgtgttgttattctgtactcgtcgcagtctttattatctttaccgtccgaagtaatccggaaccaccgaaatccccatacatttatttcataacgctgaaattggcctttttggacacccacccacccccttgtaacactttttgtatgaatatcatacaatttttgtatgggccgtaacatggttgggacacccaccccctccagcgttattaaatttgtgaatgggcccctaaaggtggatgttcttaaaatctatgtttatggaaacaccaaatctcttgaaatgatttaacgtcgcaattcaaatctcaagtataccgaagtcgtcgaaattatcgaagtatgtttgaggcgaaatcatgtctgaagtaaacaaacgtttgtgtggttcttttttaaagtggcgtccatccgtactccgtcaccaatgcaaatgttatgagagattgttttgcctaatgctcagagagattctcagcaaaatagaaatggcgcatgggagttttagcacacaaaaaggatgggtgcaacacaattcatattgcacccgcacgtctctttcaaattgaacgtgctgtcttccagcagcgcgtgctgctccgaaagagttttgagtcgcaccctatccctgcttgtcaactttattaacagaagggaggatcgatgaagagaaatccatcatgcgacttacgcccttattctagcacacgcttgaactatggaaatagagtgcgctgctgtcaactctacttccttcatcgattcaccatacaccactagggtgatatcgtcggcgaagcaggctttggaaaatttaacgatcattgacacacgagccataatttcatcccatttattcgcctacattcaagcctgatttgctgctgaacaggaatcgctaaagaaatttctcgcagattccttgcagaaatttcctacggcgactcccgtttgcactgacatttcttttcaactgcgtactgcgatcagaaaaatgagttttcttcatcgattccttgcaggaatttcccatgcatcaagataggccaagaaattacttacttatttggctttacatcaattatcttgataaagcctcgccaacaataattcgccaattcactcggttcatggccgcttctctccaacctcgactgtgacccacgctctccaggtcctggtgcacctggtcaatccacctagctcgctgcgccccaccccttcttgttccgaccggattcgtagcgaacaccatctttacaggattgttgtccggcattcttgcaacatgccctgcccagcgtatccttccagctttagctaccttcacgatactgggttcgccgtagagttgagcgagctcgtggttcatccttcgccgccacacgccgttctcctgcacgccgtccttagatcgtctttagcactcggcgttcgaaaaccccaagagcttgcaaatcctcctcgagcatagtccacgcctcatgcccgaagaggactaccggtcttatgagcgttttgtacatcgtgcatttggtgcgggggtgaatctttcttgaccgcagtttcttctggagcccatagtaggcacgacttccgctgatgatgcgccttcgtatttcccgactaacattgttgtcagccgtcaataaggatccgaggtagacgaactcgtccaccacctcgaaggtatccccgtctatcgtaacactgcttcctaggcgggccctgtcgcgctcagttccgccaaccaccacacacgagccataatttcaccccatttattcgcctacattaggcttgaataatttgctgctgaacaggaatcgctgaagaaatttctcgcagattccttgcagaaatttcctacggcgactcccgtttgaactgacatttcttttcaactgcgtactgcgatcagaaaaatgagttttcttcatcgattccttgcaggaatttcccatgcatcaagataggccaaaaaattacttgtcagcagcgaatcaagctttatacaacacccatgacatttatcgttcgtgggagataacgatccatgaacataaacaagacagacacacaccacccactgtttggcgccgatcactgtgtgtcaacacttgtaacattcgctgatccagtcccattctgatcaagaaacagaggcgaatattttccattttctgtgctatgtttgcaaccaaagggatgttcaatgatccaatagattataattaggttgttaaaggctgcataaatagaaaatatggaagttattaccaattttatgcaaaacataaatcaccagtatggctctttactgttgcagtctgtgagagttgctgctcttaaacgctctcgtgccacgtaccaaatgagagagtgaatgtttacattcataggggtctccgattgcgatgtgccacaaacagtaacactctccgaatatggttcgatcgaattattttttttgtatggtattcagttggagctgcctaacagcttaacttgtcaaggctgaaccctcggtctggcttttgccaagtttcccctctaccaggaccaatactcagacggactaggctatggtgcccacatgaacactgtttttttattagtattgtgacgtggtatttttttttaaatacccatattcccttgcttctgaggggcccagatagccgtagcagtaaacgggcagctattcagcaagaccaagttgagggtcgtgggttcgaatcccaccgggttggaaattttctcgacttcctagggcatagagtatcttcgtacctgccacacgatatacacatgcgaaaatggtcattggcatagaaagctctcagttaataactgtggaagtgctcataagaacactaagctgagaagcaggctctctcccagtggggacgtaatgccagaaagaagaagaagaagaatttccttgcttctgagaaaaggaagcattgtaaaaatcagcagcttcatcagaatttttgaaatagtagtgtagtagtgtcataactaatagtgtttagtcgaaatggttttgaatactttgtcatttaagtgctattttgatcactcctgtcttttacgtaagattagaatcttaaatgtcaattgtcgccatgtcttaacaaaattggctgtttagtagtagttctagttaatttcgttttttgttgttaaaagtatttattggtcattacgttcatatatccttaaagaaaaaggtcactttcctcgtctgttcaacaatttctcgaaactagcatgtgttccctaatgatcgatctcagcatcttactttccatagtcattttatagtgaacatttaagagtaaagttaccttaggtttctattacagtctcctacaagattcacttgtcggtggcaaatgcaatgcttcacaacgcctactttctacttgtaaattttgcgaaaatgaagctagaattagattgtttatacctgggagggaggcaccgatattacacacgaaatatgacacaaagttattttgaattgcaagaaaactctagcttgccaccgacaatcaaggcttgatgaaaatcgctaattttcttttgttgtgttccttcgatcgttctggataaacatggaaaaagggccaaagtttccaatgcatttaattttcgtttttattggaaaaagtaaaatgatgcgtattcgaatactttatattcaatcaggataaaaggtgctattgtgacattacttttgaataagcatgaatagcttttcaatcgattttttgacacatttgataaaatgcaaaactatgttttaatcaattacgcgcttttatcatgtttgtccattgttttaaatctgggctcacagtgacagttcgtgacagcagaatctcggctcaccttgacgtacaaaaatttcgtattggtttctccctcccaggtttataccattgttacaaaagaggtatttcttgttatggtaatgtaaaaaccatattaaaataagattgtcgccacttatttctactcagtgaatctactagtaattttcctcagagtaatattccctacgtcgaatatgataacgatgtgtctagctagctaatagtaagagtggctacggatcattctggttagcaaaaggcaaactgaacgtcaccaatagtattaatgtccacttcgaatagattaatcatttgaaatgggcatcaattctatcaatgacgcagaatgtccgttggatcacatccgagatattattgcgtctatgccatatgaattatgacgcggctttaagcaaaaaatgccaaaatgtgataccaccactacaggttacgcctttggtttccatcatatgggctaatggattatgccctcccatcgcggcaaggtcggatggccaaggggagggtttactgctaaggctatctgggaaaatacctaaattataagaagcactgaccaatcgatcagattttcagtgtgaacgattatcgggttctctagatatgtgctcttgaaaattagagatttggctccgatgcatcttcaccctaagaacagtcacgggacaattcttgtccacgatgtatgcaagaatcggaatctccggatgattaatgatcaggatagattcggttcacgctagtaaaaatctctatacacattcttccaaggcgtgtgtcacctcaacaatcaaaatgcatcgctaattaattagtcagcaacatgacgacctgccgtttggcttttcacagctcagcaattgcaccgcaagctctcgcctagtagttgtattacctatatcaactctttcctataacaaatctgctgataacgaatataacgttacggtgtacgactataggcactacgaagcgacattgaaaatttatcgacatatgtttccgataataatcgccatataatgagaagctcaactgctatacgtatagcttctggctacgtcacgcccatcgatgtggattatcatttttagttgattgagcagaactcaacacacgctgcagtgacaacgtgttcgacacgcgtacgcacgacgtatcgtttggcgcccaacgtcacgtccatgaaccggttcgattcgcttacgtaaatttgcacgcttcgcctatataaacagtctatatgaatttgcataatttcgtgagcagtgctgccagattcgctgacattcaaatcttgaacaactattttaacttaccgatattatgtttccaccaacaggtgatccgcaagggtaagcacgtcctgccacatgtggcccggctctgtctgattgcgaccttcctcgaggatggcatccggatgtgggtccagtggaacgaacagcgcgaatacatggacatgagctggggctgtggcaagttcctcgcgacggtgtttgtgcttatcaacctggtagggcagatcggaggctgcgtgatggtgctgggccggctaaaggtgaccatcgcttgcggcatcctgttcttcatcgtcgtactgcaggtaaggactcagacactcaagtatgttatgcaaaatggcctttatgactaacaaggccttatgccaaatggctaaccctaaagtgaccagatgtgattggcttcaatgcgggacaaaaaaggtaaacttttgaaaaatattgtaatactaaaaagtacaatgccggttcaatttttccaaaatgacaaaaattttcatatttcctaaattgaaacgtgccaaaatcgaacaacgattgatttcattaaaacttttatcaccgtaataataaccacgaattgagtttacctattttgaacaaggtatgtctcaaaaggactcacagaaacattgagattaatagtgccaaaatcaaacgagcactgtttacacattcttattattttttttgaagtaatcaaataataaaatttgaagggaatttataagattttaaagctatttatatatgaagttttaaaataatagtaattttctgattcgcatttttgctcaaaatttcacatgtgttttccaatatttagttgcatttccataatttgttttggaagagtttatatggaatatttaatagatgaaaaatgacaaaataagattaaatttaaatctggatcacgtgatattttcaaaccagcatattcaatgagttgcaatcagaattttgtaagcctcacatacctgtttaagagaaattaaagcaaaattgtatggtgtttcgaactaaattcttgttagaactttagactgaatataatccaagaaagaatctaaaaaagtatgggttagaaacggtgatttagtttgcttaacaaaatcccaagaactcagactttattacgatcaaaatctttgcaggaatagaaaaatcattttgagaacaatttgaaatcaaaagtagattctgaacaaaatcttaaaaggtttcttaacagtgtcaagaaaaaattcagaaccacatcatgagctaaaaatatagttaataattttaaatcccagccgagtacgtggattttgtcataatttcacccataatttgtccatctttaccacgcgtaacaagttaattaatttaataaccatgcggattggattaccagacagccgaattatcattcaacgttaaccgaataagcgtcaatttatagttaataatattttgtcaagactccagctgaaatattttgaaaacttcttctgaatttagtaaattttgttagggttctggtaatgggatgtgtagaatcaataaatttagatcagaaatcagatattttaattaattttgagaacaaacagaattaggctaagattttgcgtagatttcagcacgaattttgtacaaataaaaacaaagttctgttcaaatattgataagaattctgtttagatcaggattagaatcttctttttccatggaaaaagccgaccagtatgtgaaggctaatttttaatttctgtataacaattaagaacttttcactgttgatgcttcaagtacaaagtttttttattatctccacaatccgggacgttttccgggacgcttggcgatgcgggacaggttgctcaaatccgggactgtcccgcacaatccgggacgtctggtcactttactaacccccgcacccaaccaaaaaccatccaccattaatcgtcccttattccattcgtagaccatcgcctactcgatcctgtgggacatccagttcctgttgcgaaacctggctctgatcggtgccctgctcctggtgttggccgaatctcgcggggaagcccgtagtctgtttgccggcgtgccatcgctcggcgagaacaaaccgaagaacttcatgcagctggccggacgcatcctgctcgcgttcatgttcatcacgctgatccggttcgagttaagcttcctgcaggtgctccaggacatcgtcggatcgatcctgatggtcctggtggtgatcggctacaagacgaaactgtccgccctgatcctggtggcgctgctgaccgtgctcaatctctaccacaacgcctggtggtccattccggcctacaaaccgctgcgggacttcctgaagtatgacttcttccagacgctgtccgtgatcggtggactgctcatgatcgtctcgctcggacccggcggtgtctcgatggacgaacacaaaaagaagtggtaaagcaagagccagaaacgatgatccgtctatccatcccccgcctcattgcaccggcaaatcgttgatattcgttccgtcatcgtgtgagagacagagaaagctagagaacactgaaacactataagagagagagcgagagacagcgcgaacgaaacatttttttgatttgataggattttttaatataaaaaaatattttattgaaattttgtatcgattcatccatcacacacacgtcgaacgaaatcatccggaaagagaggacacgcagacaacagcaccacctaaacggaagaaccatcgactttgtgatagatagacacgagacagagagagaaagagagcgagagacacttccatcgaatgcatgctaaaagcgctgcgccagatccaagactacagactattcccgaacacttgatgaacgttgagttttctgcaatttcgtattatggccactaggtgggaacatttattttctgtttgttccgttgagaaaaagaaaactgtgcatgatgaaaaagaacaaaccaactataattattaagagaagggaaaagaaaagtatattaactaaataaagccacaaactgattagatttttaccttatacaacaaaaaacccgaaccggctctctgtgtctttcaatggttttttcagttccacattttttgcgtccaacgaacatttgccttctctcttactcgcggggacccggtttcagaaaccgggggtttcgcaggtcctaggaaaagtgcattccctcccaatcaaattcatacgtcgtactttgaaggagtcttcaggtgtgtcggtcgggattaggccgaaccacttggaaactttagttagttactataatcatcaactagcagtaaatagttaacgttgcagattattataaatatgaaaattcagcttaattattgcgattaggtatgttgtatactatactagctgaaccgcacatgaatgatgatgccaataaatcttttatgtccatatgtcacaacattcggaatcgtctggattgggtattttatttgttccaaattcaaaatttaggttttctagagacccctttggtttaatcatgatttctgtaaagatcgttcagatcaagcttgttgccttttctgtttcggctaatgacccatttcgtccagtagttgttctctttcttagattctgaatacatattagccaactggtcagcttatccgatcttatcgtgatgattttagctttgaagtattatttccagctatttaatgcttttatgctgttgagttgcatccttagcttttctcagcgtcattcaggtgttcatgataatgttgccctcaccattcgagcatcacacgtttgtcttgagatattcatttcatttatttagttaacatctacacagataacactgaatcaacaatttcacgccacaattctcggttcgtggccgcatctctccatcctcggttctgccccacgctcgccaaatcgatacgcacttgatccgcccacctagctcgctgcgctccacgctttcttgtaccaaccggatccgaagcgaacaccatctttgcagggttgctgtccgttatgagcaaagtgatgttaatggttcaacggtttattggcaagtgataacagaacatatctaggggcccagatagccgtagcggtaaacgcgcagctattcagcatgaccatgctgagggtcgtgggttcgaatcccgctggtcgaggatcttttcgtgaaggaaattttttcgattcccagggcatagagtatctttgtacctgccacacgatatacacatgcaaaaatggtcaatcggcaaagaaagcattcagttaataactgtggaagtgctcataagaacactaatctgagaagcaggctttgtcccagttgggacgtaatgccagaaagaagaagaagaacagaacatagctttaagtaactaactagcttattcatagcctactaatctagggt

SEQ ID NO: 193 - DNA, 3100 bp, Aedes aegypti
attattgatgtgtcctacccataaaaacatatgttttgtccctcccaaaacaatcaaaacaagaacactggacgccatgttgaattgatgttgggttggtaaatattggatcaagccaccccaatgagaatatataccgaggtgaggaagacgacatttagtgtgcgtgacatccgtgtacggtgcaaaatgtttcacaactacaagcgggcgagctcccataagaagccgtgtaaattagtgacgtagttatttttgtttacgttttttctctttactaatacatagccattgcttcttcttccacaccttagtatatattctcattgaagccacccccctgagttgaatcccgtctccgtgtggtaaatgtttttgtggttcttaagttcggcccttatcgcaaagtgctccgaaagtgtttcttgcgctgaacacatccgcgaaacggttagtcgaaccctgagagttgaaccgattcgtggcttgagctgtcatttttgaatcggtcactcatcgcgagcatgttgttttgatttgcgaatcgccttccagtaaacacgtgcattgaaattccctgttaaagttctgcttatttttcgtctaaatagtgctaaaaccgcgacaaaaccatgaaaatcaaagcatcgaagaaggtgcaacccacggaagctaaattgcaccagctgaagaaatccaaaagtgacatcgtgaaaccgaaggagaagaaatccgccggtttgatggcagctgccgtgactccccacacgtttgccgaaaagaaggtgctggcggtcaaaaagaaaaataaaaaggacaaactagcagaattgggcaagaccaaatcgcagatctcgaccggtcaggttccaccgaagaaacatgaatcgaagccggaaaaggggttgggtaaacagcaaaaagctccaaaggcagatgcttctaaaaagaataaggtaaaattcaaattttctgtttgatagtttaatacagtggtgctcaagcaatgctctaaaggcgagatccaagattccaaacttaactattttgtcattattctgttgattactgattcattcatttcaattttattttcatctgattaaaaaatttacgcttaccacattcttgaacttcgagccgcaggatgagcaccaccttgttagaggataaggaaattttttaaatttaacttttcatgcacagggcaccaaagtggcaaaatccgaaccaaaaccagaagcacagaaggaaaacgatgccactgaaacactggtcagcaggaaggccatcaaaactgcactgaaggcgtgcaagaaagcattggacgaaggctttgaccagaagaagaatctgttcggagaagatttgaaatacggtctgcagattgcctgtgtcaaaattccggatgtgccaagcagaaactgcagggtgtaggtttttaaaacgcttatttgtgttttggcgcaataacattgtatttctttttcagacaacttcccaatgccatttacaagaaaggtgatgatatctgcctgattgtgaaggatttggaacgtggccggaaacaagaacatgaagagacccttagcttttggaacgataaactgcgtgaactgaacattgacttcattacacaggtgattccgttccggcagctcaaacaggattatcgtgaatacgaaatgaagttgaagctggtccatcggtttgaccgattcctggtggatgcccggataaatggccatgtgtacaatttcctcggaaacaatttcatcaggcggtgcaaaaatccgacccctgttattttggacaaggacgaaaagatcgtcaaaagcctcaacaaggccctgggtagagtcacgtacaaacaaaccaacacgggaaggataaccgaaattcagtttgccacccacaaaatgcccctggagaaggcagttgagaatgctgagtcgcttctacagaccatgaaaacacaatatccaggaggatggcgaaacatccggaccgtctatctgaaaccgatgacggacatccagcttacgttcccactgtatgtgagcaaggaagatcccaacttggttccggtgccgaagattaccggcccgagagagcgcttcgagaagagtatgaacgaaaaattgcaggaagccacaatgaacaagtacaagttccaagaaggcaatttggttcgtgttgattttgaaaaacgcaagacgaagaaggataaacgaacggtggtgcaggagcaaagcgaagagcaagcagaaacgaaggaggaagatgaacaggaagcagacagtggcgaggagatggagctggatcaggctagcgatactgaagagagtgatcttggcgatagcgatgatgaaaattgaactacctgtagaaagaggtaagtatgacccggatgagttatctctgttttcacgtttatgcggaattggagagatttatatcttaatatttttttttcgaaaatatagatttaagagaaatgacacctgaaggtaaatttgtccgaacgtccaattgagcactttttttatttagcttagcttagcttagactgactacacatatcaatggtagctattccgtgattgagcgaagtcagtgaaaatgcacaaagaatcaactagaagttcggctgggattggccataatcttcttcagtgtgcataattcagtgcctctatttatacagggtcaataacggcgccggccacgtccttgcagtcaggtgggattgggggaaggaatgttaggttacaggattcactttgataagcaattagacaatgataaacaattatttgtgatatataaacatgcttgtaaatataatatattcatttcatatggaacatttctaagtagaagaaaataatgtcgacacttgacgtgacgattcaaagttaatatcagagcgcaacattcctacagctgtaccgacgtgttatcatatttgacacatgaaaagaaaaaagcttgattggctggaccttcacagaacacccttatgccgacacttatagtggcgaaccattcaaagtttgttgaataaagtgaaacttttgcaagtctatgcttataaggt

SEQ ID NO: 194 - DNA, 7155 bp, Aedes aegypti
cagtcgagatgaattaaaagtgccgaacatcagatccggctcctaacgtttgataggcatgttcaaaaatgaaatatataaaaataaaaaagcaacattctgaatgcaaagtaggccgtcattgaaatttgtactcgtcattgatgatacgatgacgaataagggctaagtagcccgtcattcgatctggcagccttgttgacactgcagctcgcaatttcaaagtggaaaatctcagtccttatagttcataatgatctgaaaaagtatcaatatatgcactggcatgctgaaagtatgctgatactttttcagatttatttctaattcatttcaagattccaaagcaattataatcagttggggttctttttcaataaaagctaaagcaaaattaatgcagattcccaacgcatcatggcgccacgttaccgctagtatcagctaaaacgtgtctttactacgttttacatgtgttagattcctcttgaaagctaacttactgctgtcacgtttcctttatgttgtgttctatctttcgtacacacaacatatatctgtcattcgaagcttgacgtgtacttttgccacagttccagcgagcggttcgtcgaagaatgctgtttcgttgatttctcttggagactggctagtgtttctgtgattttttttgcaacgggtgacgcgtgtcaacaacaactggacacgaatcccatccaagaagggatgtctgataaaaagaaagtaatcattgcggccgtgggcatttttgtgtgctatttctacttcggcattatccaggagaagatcactcgaggcaggtatggagatgaactgcaggaagatggaacccgaggagaacggtttaccttcatgctggcactggtaggcgtgcaatgtatctgcaattgggttttcgccaagggttagttataacaggtgatattgaagttgtaattgtaaaatgtaatttcttcatattttagcaatacttatggtaaagccacagagtcaagacactacacctaaggtgtactatgcgtccagtgctttgacatatttgttggccatgatcagctcgaacatggccctcagatgggttgcctatccgatgcaagtggtggccaaatcggccaaaccaattccggtgatgctgttgggcgttatgttcggcaggaagtcctacactgcacagaaatatatgttcgtgctgttgattgttgttggagtggtgctgttcatgctcaaggaaggcaaaactagcaccagtcctttagagaaggaaggcttggggcagctactgctgataatgagcctgattatggatggattgaccggtgccgtacaagtaagtatcgcaaacaattgattagattcagggcgcacagtacagtctacctacagttatggatcaactaagggacatttttcagtacaaaatatgattaaaaatcatggtgacgctgtacaaaccaaaattacctctcagggactgcagaatatagttgattttgataatacaccttaaaatccgcggttatgtaccaaaaagtgcggcgctacgatgttgcacttgcggaccctcaatatgtcggaaagaatgcgactaattctcaaaatattgcgagaattacaattccatgatccgagtttcctatcgttagtctgttatcgatgcctgggtctatgccgatggttccgatgggattgacattttatgctttctacttacgattttttcggttggcttgtgaagcctgcatcggaggatcatcgtgcacagcactattttaaatacactaaaactaaacatttttgaagtttcacaattagaaaaataccaacaatatttaaattttgggcatcaccataaacagagtaatctatttcgattcaagcattctaatttgtaaaatctctactttaaacttaacgaaattctgaagtattttttataagaagaaacgcgatcttgatggtagatatcaagtctggaacgcgcaagaatttgtcaacttcaaattgatgtgctccttttgaaaattcattaaaaaacctgaaatgctgcatttgaaagttgactgtataaataatgattgctatgatgagttttcactttttgctctttagttttcttttcaaaagaatcgagtgctttgcaaggacccaagcagtccgattcattttcgcgcgttcggagtgtattttcgctggcgtcgttcgtttgccaagtgctttgcgaaggctcaagctgtccgattcattttcgcgcgttcggagtgtattttcgctggcttcgttcgcttgggtagtgctttgcgatggccagagcagagtgcgtggtctttcgatttggttgcgtgttccgatggaacgcgcgacggaatcaaaacaaatcgtgttcggttcgcgtcattcgagtgcggaaaaatagaaatcgacaatagtgcgtggtcttttgattcggttgcatgttccggtgggacgcgcaacgaagtcaagaccaatcgtgttcggttcgtgttgatcaagtgcgaaaagcttcgtgttcagcagaggatgaagtactggtgagatcgtttcatgattatgataattcatttttatcgttgctataagtagcttttattttattttcaaacaagctatgaatggttcgtcactacaagtgtcgactttttcgcgtttcatataaacttaatataccattatgtttcgtcattggtcaaaataacatttgaatagttcgacattatgaatgtcgacgtaagacatttttttttggttgcaatgtaacttttttttttaattttcaaacatgctttgaatggttcgtcattacatgtgtcgacaatacccgtatttctgttacatacacttttcaaatacacaatcctttctgtcttcgtcattattaaaaataacctttgaatagttcgatattatgaatgtcgacttttttataatttctttcaatatatttttactgcgatacaaaaatgcaacactagttttaagtttcgtattttccctcctaatccatggatcgcatcaccgaccaaaggtgactcccagatctttttcctccctcaataaccacacctgtcccgtaatgattgtggagatgcagaggtattctcggtctttagaagcaacgatcattacacaataacgttccttacccttcccaactgactgtaaggacttggccggcgccgttattgatcaataatatgagagctgctaaaattgcacttcgagaatatgcggaaaatcccatcccttattcatttggatcgaagtgcaattcttaccggttcggatcaatcacggagtagcaaccattgacatgtacagtcagtctatgctatgctatgctatgctatgctttagttttcttttcaaaagaatccaacgttctcgcacaaaacttatgtgaatgcggaggatttcaagcagttttcgggacagatattttataccgcaacaggaaaaaggaaggttgccgaacttttcaaaaccatcaaactatcgatattccagaaacaatacctcgaatgccatatgcacgtgtggtcaaaaaagtgacattttcatcactacggaaactatcaatcaagtgatctacgtctaaaagtgcctttaaaagtgactgctattattcctaaggcagcataggctgtgattcgtttaactttaagttaaaaacttgacagttcgatatttttttttctcgaatggttaaatttaacttcgcggtcgacccatttcaatcttcacagatgaatagtatttcagaacaaagttgacagatagttagttattttcaaattttcgggagcacaaaataacttttcaactgtcaagtttaaccatgctccataacagggttattttttaccggaggagaaatagccatcgaactgtcaaattttaactgatagttaaacgaatcggtcctaaacggttcacaaccataatagacttgtgctgttctggccagacttggcaagctgtcagtatgggaaaaaggcaatcgagaggtatgatgtgaacaacatggttttggtacccaaagaccacatccttcccaacagcccagaactccgtcctctcgagcggtatttggccttaatcagatgtaatttaagagaaaaaaaaacaaataaatccacagaaaacgagcggcagtttaaatcaaactggcgttcggcggtaaataaggtcgatgagaccactgtacaaaattttatggaaggcacggcagttcgggtttggcaaatcaaaataataaacgaatattttttccttcaaataggaatagggtgccggtgccattagtggactatctaagctataaaaaatcataacaaaacaacgaaaagcctgaacagagatcttttggcgtcaacagaaagatttcaacctctactatatggcaaaaatatttttttttcctttttttattgagggattttctaccgtaggcaggttcatccccaaaagggaaaaatataaaaagagtgataaaactattttttaacataaaatcgcttgagccactattggttatgttccagtagttgcgctagtgctccagtagtagacgtttgtgaatgatacaaggaattttgaacaaaatgataaatttttacataggtttaacatttttccctcggaacagcaactaatatctttcgaatgaagcataaatatcatctctgggacttttcttcattttatacacccattttaaaaactgcttccatccgttgatccactactggaacacgacggcaactattggtgcaaaggagcaatatttttgcgtaaacttaattatttatatgactttttgatacaataaaaagctgaaatttggcaaatcgactaaactagaagcgatctatccatcaaaaatagtacatgtcgtttttatcgaaaaatgtacgttttattccatagtccaatctactggtgcaatacaaccaccggcgccctatatgaattaagctacaaaaaaagaaggtttttttacagttaactctcccttactcgatattctgtgtctcgatatcgagttagaaaaccatagtaaaagttggttttcatggctaactcgatgatcccttgggtcgcagttgtatttgttttgtgttctgtaagtcgatacctctctaactcgatagtctcttcaatatcgagttagggagagtttactgtactatgaattttgactgaaagatacgattattttgttgatcgatttttgcgcgtttcaatctttattaggacctgttcattaattatgttatatgacaatttttgggactgttgaattctctcaatttatttttttgtaacaaaattgaaaataaaatgtataacgcgtaagaaatttcagaaccaacacccaccctcccattactccttacgtaatttatgcccgaccccttacttctttataattgaaagaaaaggacatattgtacgtttttcataacatttaccactaaataaggtaaatagactaccaaaggcggcgaattttttgtacttcagagggttcctaccgtgtgtacgccactgcgcagaagaatggcatttcagaaaattccaccataaatgtatatattatcatagtgatcttgtatcacagatggaatatgagatggtggaatattattcgtgttttaaaacatttaccgtcaggagaatagtaaaggatactaacacataatctgatcataaatatttgtcataagtatttttgttttgcgaaaattatgttaaactttgtatttataacaatttccgaaatcgatgttttaaaataaactattccatgttttctaagatctacatgaatttccttatttctttcaggaacgaatgcgccagcatagctctccctctgcccaacatatgatgatggccatgaacggttggagtacactgtttctcatccctgcgctgttcctcacaggtgaggccatggagttcatcgcatttgccaccaagtacccgcagatgctgggacatctggccacgctggcactggccggtgccttaggccagttgttcatcttcatgatggtatcatcattcggagcgctggcttgctctgtggtaacaactacgcgaaagtttttcaccgtactgtgctcggttctgctgtttggaaacaacctgtccagccggcaatggatgggaacggttttggtcttcacaggtttgtttgccgatatgttctatggcaagaaaggcgcagccaatgggaagtctcctcccaagcccaagagcgagatcaatggactgctaaagtaagtccgacaggacagtcgatattcaatttaattctcgcaactgtgaaagcacaaacccgtacccacatttatcattgaaacaaatgtacaataagtaagaatttattatggattgaatccagtcttcattgctgaaaatcgtcaaccgatggtttaccctgtgaaaataaattagcgcatctcttaaccatttattgaaaataaatgcgaattataaattattatttttattgagtatgtttgagtatttatgtgtattgagaaactgtcatagatgcgagtttgtgccacgtttacctcgttccgcattgtttttttcgtttcggcttatgaatattagattcggcggatgcctcgtgcaaatgttttgagggaatatatttttcaaagtaataaaagtgttttctttttattcagatattagtagagttatgttttacttttattcgatttgcatgcgttttgttcgagagtgctctgtgatagctccacacggaaaaaatccgttgccgaattcgtgtgtcatgatttcataaaaaaatatgtttcatgatatcatgactaaaagtcgtgaaatcgtgactattatgcaagaattcgtatgctcagggcgttacacaaatctaactgtaactttcttcaccttagttaacgtgtctcatggcgatcggtgatcttttcttgtgaaattataaaaaagttttgtttttgacaaagtttcaattcttcggaaccttgtcatcatatcgatgacattcttggtgaaattctcgtgagttcccacattgtttcaccacacaatcaatgtacttacttaatcctgactttg

SEQ ID NO: 195 - DNA, 25815 bp, Aedes aegypti
ggcttcatttcatcgtcaccttgaatcaagctgaaggttgtccgttgtgatgtttgaatcaacacatttaaaattaaccactagctggtgatgaccaatcgattaagttttcagttcaaacggattttcagttctcaagatttgtgctcttgaaaatttgaggtttggcttcgccttaaatcacatcaatagtcctttgaagcgcagtgcgccctttcgcagcagtgttttgaaaaacataggaaggatttcgggccaatcattttgcctgacgaaaggataaagtcagagccagctcgatacatctgaagatgatcgaaaagtagtatgtcaaaacgcgtaacgataattaatcgattaattaataataaatttatgctattttccttatttcgccgagaaaatccaataagatttcacattatcaagctcagaaataactgtattacccaaccaccagaactttgatttgcccatcacaaattccacgcgccacaccgtccaccgaatgtgtgacaaacttgtttcgacagctcgctattgctagctagactttttctaatcgattctgaataaccgggttcgtgttctcacttccagatgaaattactagtattagtgctggcgtcactgatcgccgtctgcctagccgaaccaaagcccgccatcaatgaagtcaaatcgaatcagccccagcagaagccgggccgattcctatcactgccagtgccggagaaatgcgcaaaccgtaagtatctaccccaaagatcattcggctacgtgattttatgtagttgaacgcaccaagcgtttgtcggacattcaaaccggcttgttcaacttgcgacatcacggttgctacagaacgaagctagtgtctagccagcaccaaaaccagtcgtctgtcgaagcgcggtaaaccccaattcgtaagaatccaattgaatttagttgactcacgcggtgctacaaattaaatcccagaccaaacatcgatcatgcgaacgcaattagcgacaaaattcacatgctgtacaacttcttaccacaaaaatacgatcgctcaaaccgggggaacatcggacgacgaaggcatccacggagaaagacgcgaaacacgatgcgaatgtcttggaaaataaatctcctcaacgcagcgcgtcccgtgtgtaaattactacgatacgagaccttgaattttaattcgacgaagagccacccgactctccgcgatcggagtctcctcctgctactgctcctccttgcgctcctaccttcatcatttgcgcgtcgtatctttctcgtcttcgatcatcttcctctccactacagcctctgccacgaactctttgtcgcgcatcaggttctcaagttcatttgaatgcattatatgagctcatggatgatggcagtcaatttagtgggggtttagggtggttctttttagaaaatgttagatgcgacctaagtttgaattacttttgaccattcttcttcatcatcattctggcattacgttccaattgagacaaagcctgcttatcagtttagtgttcttatgagcacttccaaaaattgaatcatgaaaaaaatgagataatctcttacttttcactctcagcaacaatcatgatttgcagcacattatgtgattctatttatcgtatactgctactgctcggaggatagcagtgcatgataaaacctcctgaacaagctaaaaacctgggggacactatagctattggatgtttggggattgtttatcgttccagtaaacccctaatggtaaacataagagaaaagttggattttaacaccgctctcgttcgcagctcatatttatcaaacctgttgcaacttgcgatacattaccgaccatggaccgccagaaccgaccatggatgccagaactgagagtttcctttgcctattcaccattatagcacagacaaacagacgtcacactctcatcgctgtccatcgaccaactttttaacggtcgattcgaatatctggtaggtggtcaatcgaccacccgcagcgctcgcgtcgtttttgttcgtgtttgacgtttacacactaccgccacctgttggtccatcggccaactacagtgtttttagcattgggcgtatatgttttcgcgactatgattttgattgcaatttgttctaagtgttacgtctgtttctctgtgattatagtgtatggcaatcacgaaggtactctatgccttgggaagtcgagaaaatttccgtaactatttaacaattataacagggattccactatgttgtcaagaattccaccagagattcctcaatcccaagaattgtactagggattccttcaggaattccaacttggattttattaggtgttcaaaaaaagattcctcgaattttatcatagattatccagacattgcattaggggtttattccaccaggtttcttccaccaaaagattagacctggtattctagaattctacctgggattgctccaagattcctccaggagctcaaccagagtttttttggatattcaaccaatttctcttaaaaatcaatcgattgtttttactgtctcaccagtaattctaaccaacaggtttttttttcaaagattgccccagtaatacttcgaatgattcctccagggtgcatcatgaattctttaaaaaaaaactcaagcaatattccagaggttattctagggtttcctctggaaattaattcgaagattcctccagcgattcttgcagaaattgctctaggtattctccatgaattcttcaaaggttttttcaagaaattgcttaagggatttccccctgagatttttccaggatttcattaagaggtttcttcagatattctgtcgttgtgatcctcttgattttctttttttaggattcctctaaaactcttcaaaaaattcctgcaagcactccaataatttatccagagatctctcataaattgctccagtgatacttctagagacttctcatgggcatcttcctattgttttttgttttccaagattactgcagttttctttttgaacttcttccaggcattccctcatgagtttctcaaaaaattcgatcagacattcctcatgtagttcatttaggtattgtaaggaattcctataataattcttcctgaaattccttcaggagatccttcaaagatttctcaagttagtgcttctggtatattttcagaaatttttccagaaatttctccaatttctcttttcctgtgattctttcagtagcttcactcattcagaaaatccttttgagattccttcatgaatccgtccagcgaaagctccgggcgtctattcaaattttcgttaagaccttactttatattttcatttattcttctataaccctccaagaattcttcctgagatttctcaaggatttcatgctagagttcttccgttaatacttcaatagatttatctaggaattctcctagtgttacttgtgttacaataacactgattttacgagaaagtactgctgaaactctgtcagggatgaacgtaggtaaaagattattccagaagttgatccatagattcgtacatgaattcctctaaaaacccaacaaaggctcttcttgagtttcatgcacagattcgtgcaagagttatagaagtttattttgaatgcaaaatttttttataggtaagaggaatggatgaaaggattttttgaagaatttattttttaaatcccagaaattttcttaaatggaaaacattcgatgaattcatgggaaatatttatggaggaactcttcttccttgtgggtagcaatccctgaagaatttcctggataaatacctagagtaaatcctcgcaataaccattaggaaattccacggacaatcattgcagaaattcatgtagccatcattaaaagaatactaagagcaatcggtatatgaattcttgatgaaatactggtaattatgacccacactagttagcacatacataaacgaatcgaaataagatttgttatgaaattcctgctagattcactccacaagtcagtgctactgtttggtgttacgcactgaggattactagtattttctactctgttacttatccctaattatcgcacaaaacccccataaacgtttagccaagtttagtcagaactcggaagctagcacaaattcatcatcatcatcatcctcacgtaggcggaataagctcatttcgcaattggttccccgcgaggcgccaaaaccgcactccaaagttatcgatcacatacctacacactgccaagatcccggatgcacatcagaaaatgcagccgggattgagttgcccgatcgataagtggcaaatcacgcgcatgacagtgtgatttgagcactgatttgcagcccagagtcgcgttgactatatccgttttcctctgctgtactggtgttttgttacctcactttgatggattacacaatacccacgatgataaaaatagcaaacgtctttatagagcagtgcgaatggggccttccttagactagtggttagagtctgcggctacaaagcaaagccatgctgaaggtatcgtggttcgattcccggtcggtcgaggatcattttgtaatggaaatttctttgacttccctgggcatagagtgtagtcgtacataccaaacgacatacaaatgcgaaaatggcaagattggcaaagaaatttctcaattaataactgtgggtgtgctcagtagacactaaactgagaaacaggctccgtcccagagaggacgttatgtctagaagaatgatgattgatcatttgcaatcgatcgcctggattggatattttctttcttcttccttacgaatctagttactaaaattcgaaagatcgtacatcttttgtgttacatatttactagatcaatttgagcaaaaaaaaaacaattatcgactcttatgtcaaaaatcttcatattacctgaaacgtcgagaaattagggcgaaatatgcccagtacttcgaaatatagtttcatgctgtggccatcaccagttttatttacttggctattcccaaacgaccttgaccttttttagatttttttttatataaacagtttcatcaagaaaaaatattaagtacagcatggctcacaaatgttatattgtaatttttatatgaaaaacgaatcatgaattttatttattagttgatttggctagtctgcgtagaatctatttttcgttttagacacgatttttatcagtctatttccccttacgagaggaggatttgtaagcatacattctaaatttatcatgtagtcatttatttcaataacttagtgatcctttgacagttttgagtttgagttggcatgaattaccattattgttttcattaaggttactgatagaggaaagcaagctgattgagcgatagctagaagctaaggcaggattttttcccgaaatcaaattgtagcaactttgtcagttttccatttttgttttaaaaatatcaaataacttaatttccaaatagggtacaccggggcaagttgtaacgggtgaggcaagattaaatgcaaagatttcaataggataccaataaatgttagcagatgttttcgccctaaaagtttgttccatctgttaatttaatgtttctgtaattgaatttctcatcattattaaatttcactatgataccttgtatttcatcttaccccagccgttttaacttgccccggtgtactttaatgctattaaatgacacctgaactataattgtgcacgctttcgaactgcatagcaagttttttgggcttttcgcaattatgtggactatcccccaaaaaaaaaagttaatcggctatctcgatgcatcggaaatttctttccagaaatggacaagaaaacaatttttcaatggacgtagtacacagataaaagaaaagtaattttaaataaagcccacggtagcaaattttaaaaaatatttcaattttagggaaaactgttcatttcacgatttgatcaaaagctaccgaagctgtcgcatcactgatttacactgttaactttacagctgcggtagaactctgcgactatcgtaaaccggaaaagtttgtcaacaattatattttttataatatttttacttatgctgtttatactttagttttagataaaaataatttgttttgattttttgatgtcggatttggcctttgaggtatatttaaaattttatattatcctataatacttagagccgcgacccaatggattacctgatttgctcttgcccacagatgatcagcagaagttttctcgtttcattttgtgtggggaaaggcatctaacctcaaatttctcgtaaacgaaagcaataatcgaagaaagtattaggtaggtgtgacattacgtacaaccggcaccctttttttgaaaatagttcccatttttgagaaataattcgttagcatgtgttgctccattcagccgatcattatgttatatgaaaaagtctgcattttatgcatttatgctattaatagctagaaaattaaacagctcatactctttacctatcaaggaataagtattccaattttaaatgtgcaaaaatggtttatcttttccaaagcttttatattatttagttgagttttgccgattgccttcatactaattacttaaaccaggaaaatttaaaaaaaatattattttacttttaattttttgaagatattcattaagagacattttaagagacaatgcattatttgcgattaatgttatcttcataattgacaatgtatcgtatcgtgataatgaatgtagtatcgttttttcgttaggaaactttgatccctctaactgaattcgagatctcctacttaaatacaacaaatttggaaatactgaccacgataggtggaaccctttttgactgtatctgttgatttcccaaacagtcataaatgatggagctgttgtttcaccttcgtacagactgtaaaaaaaatgcagcctaatgtcatgagatacaagctaaaccccaaggtgccgcagctgcttgagaaagcttaaaacttgtctcccaaagatgcgttccaatcggtgtgaagcaggcacttcaagattgaactcactggctccaaaaccagaaaaccattttgcatttatgtatgtttgtatgtgccccacgtgctgtcgagggaagatgaaaagttcaagtgcttcattaattattaatgagaatttcagagtttggttgtagtgactttttgcctcacagtatattggtgattgtcgatcataagtggggtgcattggtccttcctctcacttgcgatgcgtagcccatgcttaaatgcgatttatgaatattatcatgttgaaggtgcaaaagcaaacaaaaccaaaacaaaaggtttaaatttaaccccgagacaactctccgctttggggatgatgcaacacttgcatgcttcacatgaatgcagataagcatgttgttgccttcgtaggtcacaccggaccggtctccgtattggagcaagagcgcgcgatcggcgccgatagggaggcgggcataatttatgcgttatgcgccatattgacaatgcacagtagtccacgcaaaaaattgcattctcaataatttactatttttggccatgaaaaagttttggaacattaattactgttgaaaatcctattttgggcatagttagcattttttgttttcatagaacaagatttcaataaattagctgcttctcattttgaggctctcaacttaaaaaataaatgtttagataaacttaggcaagaagaatcttttctccagtcgattcctttgtcttgaaagcaagatacccccgcgagaagcaatttgtacggtattaagaggctgtgctgtggtcattcaacatactttcaataataaatggtaattaaaagaggttcatggcagacgaaaataaatttgcatcaggtaatgcaacatctggttacgaaatagctatcgaccacaaaaaaaaaattgaaacccatatttgcattgatttccgtgaagataaagtaatcgatttttgatccaaaactcatggtttttggacttttgcagctaccgttttgtctcacatttcgaacttgactcatcttccgaacagtggcgatatcagaggtaaaaattgatattttcacatcttttaaatgttgaggatttgcatcatacaagaattgatcatcatgtgaagaaattagagtaattgaggcatgctcggaatttgagaacaaacgatatttatcgttcaaacatgatgaacaacatttttcgttttaaattatcgtatgttttcttacctaacttacattgtatttgtatgtttgatttatgtttccaataaaactatgttttcaaattggatttacaaactttttgaagaactgaacctctgtgcgatgccgatggacgaccacatgccttacctagccgtgtcttggtcgctgacgtcgattggtttgcaggtcactcgcaactccacttgtgtcgtataggtagatggcggcgtggcgcaaaccgttgttgggattgtcaatgtttatcttaaggacgttgccctgcccctttcgacgggtgatcctagttttcatcgaacgttgaaggtcttctactggacgtcgagatctgatcgattacggtttccagcaagatacaccgacccaagacgagtcagtttgcttcagcacacggaatattaatgtccaaagatgttgagttgattgaactttatgcaaatttttcggttgtcgttggtgacgcattggcctagaagctatcgttttcaaaagaaggtgttcggtgctatcaaggcaccgaaatgttgaaattggcatgaaactcagtttgaagaaggttatcttcttctttcaagtcacgcaatccgtcggaaaataccgttgtttgtgcgaatgctgtggtgccttgttttactgttgaataaaaggttaaaatatgtgcatacgtgggctgctttagaagcaactagtgtgacctttttgacatggaacagtgagagtgatattttgtttcactcacgatttccagtcatgacatgcattttcgagctgcatgtgcattatgaatttatataatttcttccaatagcaactatagaaaggaatgttccacggaaaactaagagacatgtgaaacgtagagtatggagatagcactttatatgggaaactctgcttgttgtacttttatttaagggctcctaattttattcaaacctataacacaaatcttgttaaagtatagttatgaatgtgcatttttttccggagaaagcgagatgctgaaatgaatctcaaaaaagatacaagcttttaactgttgatgttttaacatgtatgatttaaatcacttgaacaagctcatcaatgtgaaatatttcaaatgtgaaaatttactcccttggaccctatagttttggctgaaaaagcgataattcacattttactaccaccaccattctaggaaaagttattgtttattcaagagcatttttgcaccttggtttcttcggtgaagttgtttggcacatgctgaaagatgtatggctatttcgtatgaggggtttagaatagttgaacgcttaaaatacaaaggtacgaaaagcaaatctttcatacagatttataggttttattaggctgtgtaaaattgttttatattttctttttactttggctttacactccatgaagaacattacatgtttcacaccatagtgttctaggactgtacagggtataggctgattgagataagcaaactcttgtctacattcaaatgctcataatttctgaaaaattgattaaattggatgtatccaaaagtattcgacgacaaattaaacatagttctagtagcttacttggccatgcatattggccaccggacactttagatgctccgagttttccaagttcatgccttaatcatatttcttctgtaacacatttttgtgcagtgtgaagttttatggatgttgacgattttcctagaaactagaactaactaaaaattgaaaactggcagacgcattaaggttcgttcgaaatattccactgcactgtaagtggtgtacagagtgcacatacattacccttggcctcacagcctgtgctcttgagtgaattgagcactgctcaaacataaaattagtgaattcactcgatccaagaattttgagcggggccggatcacgtgaggagaattgagaagcgtgcctcactcgagtctcaaaattcatgaaccgagcgaattcaatttaccggtggataagactaatgcataagttaaccaatttgacgtttgccaagttcacttgtttccatggtcatgtaagtgacacggcaccgctcaaatgtcaatgaatgaactcggtacatagataaatgctaaataaagaacttttgaaatagtccctctttccctctttctctctctctctcgctctttctacttcacactttttctccttcttacatatgacttttctcacaatattgcattcaagcacctgtacttcctttctaaccacattcataaacatgcccttatatggctccactttgctaaatgccaaacgagccttcgtatggatcctctacatatgctttacaatacacatcttccaccttcagtataaaaattacgtcactctcgttcccccaaaactcggtacttcaataatggcgccggccgttgtgaagtaaaaatagtccatcttccgtaaatcacatgaaattttaaattttattctcaaatgcgagcatgtgtagtcattccacaagctaaacaatggaaaacactcacagttctgggatgtcaaagatccaggcgccagtgattagacaccctgttaaagatctgagacgagaatcgcggagatggtcttcttattctgcgattgctgaggttttttttttcttattccactcagtgtttacatcgatcttggacaagtcgttcatgctgtcacatgacaatctcagcaaaaaaaactattgcgtttgcatcacaccgaagcataaacgacattttgagtgaaacttcatgccagcaaacgtagcagacgttataaataactagtcttgtgtttagatttctcagcatctttggaaaaactgctccgcggactgaggtttttgataatacaatcgcctctccacatctcgatatcgaagggaccatcgagagatagggagagatcgagacaaagaacattaatttaatgaacactagattgaaaatcactccgttactaggaaaataataaacaaacaaacttcatttcgggtttccaaattgttctgaatcgcttaaatctggtctagtaacctttgataatgttcatatcgacatatagagagaaaattgggaacaaagaatcaacaagattacatcgagatatggaaatctcgagataaggagaatatcgagatatggagagagagaaatcgtatgcagaatgaagggaccgaagcaatcatcgacatagggagagatattgacatgtagaacatcgagatgtggagagtcgactgtagtttattatgaatacaacacttttcactttaacaatcaaaacgaagggctgcatttgacgtttcgtggcagtggaatctgggctgtatatgacgttgatatgtttcctcttcgcgagtctctctcagtaacagagtccatcaagaacttgggcaagctcaaggtaggatgaccagaatgtacgctgagcgtacatcaacctcctgccagtgtgtcaactcaagttcacgaggagacgcctactagatggtaatggtcaagagaagcgctgaaaaagagaatgtgaggccgttggtatcgtaggacgtggtatctaaaatgttgccgtaaaatagagaatcatcgcggatccatacatattcagaaccgtgaagcaacgctgtaggtcactgaatctaccgcggatatggacgcaaaattggtgctatttccaaacacgtggacatgtcagcgtatagacctatatgtacgctagatacgaccaacaagttgttggaggataattcttagccaaatatgatattttttgtagcctgaagttccgttcgagtatgatttagcctcttaacaggtagaaagttcagctcgcaattttttccgaactttttagagattgaaactgtaatttatcgtgggaatctaaatttttggttgcttggggatctatggtgccctgataaagaaagtaaaattgtccgcagcgtattcaatctccaaagtttaggcattgaatagatctaggaaacaggaactagcccaccataagactgagctagaggtcatcaactgtcgcaaatctaagcaaagggcgcatgttttggcagatgatttcaccattgagtccaagtggttccttaagcatttcttggtaatgatcgacgataagctcagttcagcgataccacgttgaatataccggttaaggtgacatctatggctgtttcggcgctatcgaggataatgtctaacagtgctgctgtaattttcaggctggaaatttcaacaaaagctagcttttcacaagggagtgatgctctccattatcggtatttggttaaaaccactctgaacaaatagatacctacagtggtacgcattcaatattttcaaaattctggaagtgagatcaactttttgggctctttgatagtttggaaggagtctatgatatttatataacgctcatgctcgcgtccaaaagattttaaaacaaattcttgatgcgcgacaatatttgctaaatttttttgtacctgctaggggaccctcgcagaaccgttcaataaaagtaccaatcaggcgatgacatttggatagcaaactaccgtagcttccagtcactcgtacctcccctacccaccattcggcagttcaactgatcttcacacgatcttcggcagcacatctccgctactccagcatagctactacactagtggcttacggagggccgttttgcggcggcctataacgcatatgatttatcgaatatagacaacaaccgatgaaggaccctggctgacttgcggcgttgtgcctcgtccgtcttcaccactagcacccttccgatccactgagcgatcatcagctgacgggacatgtgccatcgtggcagcattggggacaagtgcacaccttcgacgacgaatacttggaagcacgacgaatggttttgcctgcggcggatacccattgaaaacatatgaacgaacctgccctgcgtcgatatcggttagcctcgaaaggtcataattaatctgacccagatggcaaaatatatagaaatgaagtgagaagtaaaaaaaacctgtccgtctccacaacaacaggttaccaccggagccaagggtgaaaggatgatgcattggattccacagaagttgatttcggcccgttgtggtggtacttcggtcaatcgagtgtcgaaagaaccttcaaccagtataccggagtgctaccaaaccagcagaccacgatcgcagacatatgaatcgtgatcagcgttggacagaaggatagtggctgtggaatagggtgtcccaaaatttgcttttgtcaagtaatatggggacccaaacttctaatggtaactaaggatgttacaatcatacttttgtatgtgagaaactacaagaactaacgttcagaagttgccctgttagaatttttgaagcaagtatttatagctcagcaaaattttgcgatactcattatttttatactgtttgcagatccctcgaactatgttaactatctgaaaaaaaatcattcactgttatttttgcacgattttttttcgcactgatgtttagaatattaaaaaactatgcatccttaagtacatttttattttttcaacaaaaatgggtatcaaacataaagttattttcattcttgacctatgaaagatgggaattgatataagatttgtttttaccgaagacatcatactcctaatgttacacgttttagagttattcaagatacacagagggcagaaatgtgacattctttaatatttctgctgaatatcacacaaatgtgatcctttttccaacatatattcccatgaaacaaatggaattcagtggaatttcatatttggtagaccgtgttaatctatttagattggtgactcctattacttcataaaaaaataacaaatagtgatcgtagaacagattgtttattggtgttttaaaaatgttaaaatctcatcaatttttgaaacttgtccgaattatcatagataccctgtttaacggtacgcacttttgatgttaaaatgtaaaataaaaatgtactgaaaaaagtatagtcaagaaaaacgggttcaaaaatcttaaagggacgacctctaaacgtcatttcccgaagttccctcaacagaaaagtttgattgtaacatccttagctaccatgtggtggttgagttcccaaatttttagccagtgaaattctgggacaccctactgtggagcattgcactgggactgggacaccctacggttcgagcattgcacttaaaattagcgtttgttacggttcgattttaagtagcataaaaggtcaccggcttatacccggcccccaacgggtaccgttcaataacaactacaccgcatagcactacctattacggcgatcacacgtcagctgctgttattgttgttgtagcggagatctttccagatgcttgcgccgatagggcccgtttgtctgcatgagatctatactattcatagcggtaaaatgcataattaaaatgtgatttgaattaaaacaaacatcgcacaaagccacgaccttgatctcgatttaattcgcagcacatttctcttccgtcataaagtttaaaaagcaatgttcggtaagaccgttgaacacttttgccttagtcttacaaacatttgaaatcataaatgtattaaactcactgcttaaaaatataataggttaaggtctaaaaccatatatggtcatttcaatttgttaaccttggatacgtagaggcctgagttcaaagtttatacggataatttacggacttatggctagtgcgagccgcatcgatccaaggagtgtggattcgattctcactgtagtccgggaaactttttgtcgcgaatgtatttcgactatgccctgggcgttgcatgctagttcgttgtctagtgtggggctcccttcaaaagtcaatgaaagcatcaacaaatcggtgtcttaaaaacagatcaaaaagggctggcaatatcgggtaaatattgtgcttacttggtttggaatcggtctgaaataaacataaagctaattttaataatatctgccatatgatatatcacgtttttcgcttaaggttgatacaaatattaattttctttcttgtcaccctcctttatgaacgtcgaaaatgtggaaggggataaagaggttaataatatttgacatctatttcatacctcaactctttaaagtgaaaacccggtaaaacacggtcaaaaaatatgcaaagaaacacgccatttctttgttatttattcgttatttcttcttcattttttccatacaattgaaaatacaagcttgtataattcaccttattttgtttttaatgttttgttccttatttatttttaattccgaatttgcattttgcttcaaagtttatgttcaataagaaatccatttttttcacacatacagttagcctgtattaaagaaaattgcccatctttagatgtatactgtggtatattcagtgatttaccaagttgctagaatttaccgactaaccaatcaatcgtaagtgttttgagttttgatttagattcagtggcttaacattgagtgaaaaacatttccttttgatttttggaaactaatcacagaaatagatcaacatctccccgcaatcaaagaattgaacttttgatactcaacatattttaataattattatcacatcgagtcagacttttgattacatgatatcagtacaggttttcaaaataattacattaaacgtcagttacgtcagttctaattttcaaaaatcttagattttgttgatattttcacttcaattgacctccgtatcaatccgaacactccgatttatgctctaaatcgtccgtgcgtgataaaaattgaatcaaatttgttttttctcgattaaagacgcagtgttcattttgccaccacttcccctatatacagccattccatgaaaaaccgatctagtgggtcaccgaattccgtgaagcatattttcattttgttttgttcatttatttcccaatccgaaataaggatacacgtgtttttggattttttgattaaggtgaccatttccaaaacagagtgaccagaaaaatcgcgattttgcaaaatttttatttttaaaaaaattataacttttgaaccgttttaccgatttttaatctttttggattaaatgaaagcttaaaattttgacttttcagaaaaaatataaaatttcacaaaaattgtttttgttacatgaaaataaatcaataatttccgtttttgtgctttgaaggcctcaggaccaaaggggctattgctgttctcatttttttagtttttgagatatatttttttgaaattaaaattcagtcatttttcatcggcacacactgtaggtctcagcgcattagattttttttatttaaacaaaaaacataacttttgaacaactcaaccgatttccaaaaaatgaaatcttaagatttcaacttttcagacaaaattgaaaaatctgaaaaaaaattacatgaaaaaatataaaaaaatctagttttttttagaaattttcatttattttgatgtaaaaaaatatataccatgaccccacagttatggatcaaatagtgtggagtccaacctataaaattcaataaaaacgacatggaaaacgtaaaattgatatttaaaggcacgaattgaatcgtttcaaagcgaacttcggttagtaaactgttttgagtgtaatatttactcaggactgcataaaaattaaaaattgtatgggtttctgaaaaccatattatggatcaattttcatattatggatcaaattgtgacatattacggatcagtgtgcaaaatcaagagattttcaactcaatgcatctgtattgcatgatttggcgaaagttaaccatgtgttacatattactgcaaaaatagcagtattagagctgtaaacaagggtaaaatgccctttttttgtgaaactgcattgtagtaactgagacatgaactgttttcgctccacaccaagtttcccatccatttttgtccgctaaaaaatgaaatttacaaaccttgatgttttatcagttttatccttagtgctattgtctgaaaatgtcaaatccaatgcttaaaatggcagaaatctacattctttggaagtgatccataaccgtggtaaacaatcatttcctggtccatattatggatcactagttagaagtgctaatattcggtattttagaatcaacaatcaagataaatgttttccaaagatgaattcatactaaatcgaagcgaacgagcatgttttatgctataacatttgaattttaccacctgtgggagcttatgaatgttgacggcacttcttacagaaaacgaccatataatgatagctgtgtggtaccaactaaacatttgtcaaatacaccgttatttagcggtccaatgttgtgcttaacattacaaatggtagaagacaaatagtataacatgggaaaaatatgttttacgccaacgtttatgttttgagcgagttatccgatgttgaacgccaaagtgatccgtcactatgggtgatccgtaactgtgtgggcatggtatgtcagcatggatgatcaaatgaatcgactctcgccaaaaaagaaccacggatcactcgctcttttgagtgattcggatcttttgaacggctccgattctttttgtccatctatagtactgttattttggaatttttactgtctttggttaaattagtgcatggattttaattcaataatttacctgttctgtgtgttttgtatatgcagattttgactggattatctaattcaacaattgatttaactgtacgtgactagcttttagaagaaaaaatatatttaacccctctaccggcagcttcatttttgatcgcaataaaaatattaaaacctcgataacttttttgtttctcgatatatttgcaacattatttcacaagttctcaaacaacttttctagttttagaatctgtgtcaatattgttcattagccaacaggatcctgagatattccgaaattccttggaggaccgacatgtagccgtaacccacgtaattatctcaggctacataaattttatcgtattcggatattcactcttcggaacaatacattaataagagtatgttgaaaaaaaaataaagcaatttggtacagtcgtctttgagtaatgatcattcatgtgtcttgtaccacgctggccgtataaagatcttaaaaacttaaaaaaatacatcatatcgtcattgtcagatatctcctagaatacttaaccgatttgtatgattttttcagaattgcttcttatcaactggttctgtgtagcctacattttattttttgatagattgacgtaaatcaaaatggcagccaaagacagtttatatggagaatgtcggtcccccaaggaacatcgtaatatctttaaaaccagatcacctatgacagatatcaacgtaggttcttaaactagaagagttattgtgaacttgtggaaaatggtgcaaaaatatcgagaaacaaaaaagttatcaaggtgagaacatttttattgcggtaaaaaatgaagcagccggtagtggggttagggcctaattttaatgaatatatattcaacatcacctgcacgttttctcacactcgatgcttgcctttttttatgactactcacgttaagctgcctgacagctcgccagccagggtcggagctagttgttgtccgaatgcaagattggtgtggatgcaaggtgcaacgcatctcgtaggattgcgacaacaaccttctgcaattatgtttactagattatcaactagtgtatttgtcattctaggctcaattgaacgcgatagtatgcggaacgtaacagtgacataggatcagtttaaatatttttgaaacgaatatcccatacaaacttcaaactgaatgcaccagctggtggagcaatcgacggatttgaaattttgagagagcttttttcttaccctaaggctatatctagagggtgtccctttgagttttacatcttttttgtttaagggcaagtctagcctacagtccatttaaaaaataataattttaaattaagaatcattaagtcattgagtaattctcggagctaatcgaaaatataggcttggaagcattcatccgatgactagaaaaaccactatgaaagctcataaaggtcttacttctaaattcttttaggtcaactctagatttcatcgagaaatttttcgaaaaacgttttcagacatttcaagttttttttgttataccaggggattacacttgaattattccggatgttttttttttttttcaaaaaatcggctaggcagccaaaaaataccctatgcattgctatcaggaggctcagagaatctttcagttttctgtttctgttagttaaaaggcgttttgaaattgaaataactgtaaaaaaatagaaagaataccaaacacttagaataatccgcagctttctatgatccgccaccatatatttttataatcgaaatttaagagttttcattgatggtaatccaaagttttttttatagttatatacatgtctgtagagcgttaaattaaccaggtcaggttgtcacttttggcttaactgttttgaggtgatttgttttctgaaagcaattgtataacttgtatacagttgaagtttgctataacgacatcgcaagggaccgtcgtattgaagaaatgttgttgtagagaatagtaataataataaaatgtttttctagagaccgattttttgtcgctataaaagtggtcgttataacgagcttcgactgtacaacataagatttaatgaattcacctttataactcttatacgaccagatttaaacgcctatatgtattcaacgccctgaactcttcaagtatttcaaacaatcttggtagaaatatatttatgtagggagacttacggcttcggcaccattcgactattatcggcaaccaaatttgaaactccaaatatacagtatttttctatcaaaacacatcagtggaaacattcagatgattctttgttctgcccgcttcccgctggcgagattttcgagactaaacaaacgatatcaccgaagatgtcatcaattcaaatgagcacgcctcaaaatgcgactgatttggagctgccgaagagattcaccagcagttgttatgggaaagttgccaaagagattgaggctgccgacaattgtcacactgacaagggatgttcgcagcgttgtaaaaacgtttccaaaagcattttgacaagtctgtcggtgtgaatcgatagaggattgagcaacgcataaatgtaaatagaaaaccacggaatttgtctgctgatgtccgagaaaattacaaaagaagcacggcatcggcttaagatgattatagaacgaagccacacctcaaattttcaagagcacaagtcttgagaaccaaacagcgcttcccattgaaaatgtatcccattgctcaccaccagcaagcaagcaagttgatttgattttccacgcgatctgttgccagattctccagtcttgtgcacttgaaaattcaaagtttggctttgctttataatcaccttaagctgccgagaatacgtaagttcccctacataaaaaaataagcgaattactaaactttatttatttatggctgttttatctttgcctctttttcattctgctgtggatttgcatgctaaatgtcatttcaacagggttcatgcacagcaatgcttcaaaactcaaaagcagatagaatccagaagcagataggaaatagtcaaaatttactaaaattcagtaagtgtgtgactatccctaagtgtatgataaggtctattcaacttagaatttgaccgcttttatttatcttttatggtgcctctagttgtcacagcgagaaacgtattacagcattttatacacatatatgtaaaagaaaaaaaatagttcgacatttcaacaaatgtttttgtgaccttcaaacaatataatgtgaagtgatagtcacagaaataacatttttcaaacctccgacagaacgttttttttttcatgggctaagtgcacttcattcactctgaccgaactaaagaacacctttcaatgatttcgtttactctgactgaacaatttctcagaaaataacaatcatgcaatgtttacatggtcaaactgggttcatagctttaaggtaaaccgattatcaaaatccttagacattagtatcgtaaattctcaaagaatccatatccttaactccaaaatcattgattttataatagtttgaaaaccaaagttttgatggatcagggcattgaagaccagaaacattcaaatattcgttcaatgagagtgaactatgtgaaactcttgagtaccggttaaaatatactaatttatctagaatcgaaggctcaagtcagaaaaataaaaaatatgataataaaataaagtacaaaatttatatttcaggaatgcaatatttccctaatgttatgcactatctgtaagttttgagttcaacacttttattaagcaagaggatggaaaaaaatgttcggttgaagttttagtgttcattagtatcagagtttagtaatttggatgagttttaacatgaaaaacagctcttgtcgcgtcatgtcgccgaacagtgcagatcaaaaagcatccttatcttacgaaaaacgttttatttttttgcagaaatttgctgatgttagagctatttgaaaaattcattattttttatatattttgacgatattattcaaaattagttcatttaaaatatattgatccactcttcattcacatttggatcaaactcgatcaaatacaaacaaaatttgtgctttcgactcaaatacatttcacgttttaaaaaccgatttaaaaaatgtttaaaagttttttttgccacatatttcatagataactctaaaagcttagcaattgcattttcttctcagtagctcctaattagcattggaacaagacggaacaaaaactgaaacaatgccggatcgttagcctaaaagaatatctttcagatggaagttgtttggtttgccgctctccatgatatttagagacaaaaggtgactattttctaactaaaattgttaataactttgaaagaagatgagatagaaagtttgtgtctttgagaaaaacattgatttgttaactattgataactttctagaataaacatttttgcttaaaccgttatgagcaaaaatatttgaaaaaatatggttttaggagtattttatacaaaatactctgtagctctagaaaaaacgtttgaacaaagttgatgtcttagaagaaaaaaaaaatcaattacagtcgaagcgcgttataacgacaccgcaagggaacgtcgcaatagagagaagtcgttatagagaatagatataacattgaaatatttttcatgggatcgaaaaaagtcgctttacagagcttttgtcgttataaaagttgtcgttataatgagcttcgactgtagcattatctataactttgctgaagactgctactcgatttgagcaaaataaaggaaaaaaaatccgcactacactgcaaggcaaaataaagtttaagcgatattctccaactctttagaacataccatccttataaaattacgtttagacatcgaacacctaaaaacgcacatttttcgggctctgaaccagtgtgtgccagcttggactccaaaatgtaaaaagatcaaatctgtaaggcggcatccacaaattacgtaacgctctagtgggaggggggtaggctcaagcgttacgactcatacaaaaattttaaatttttcatataaaatttccaattttagcgttacgtaagaaatggaccctacctaatgcttcctgttaattaaaataatttcaaataattgattaaaatgaaaattaacaacaatatcagaaaattgttcatcttttttctctaaaactatgtaggtgcttgaaattttcggtcaatttgtggaaataagtttatttttgtacttgttccattctgacttatcgccgatcaattatttcaatttttacattacaaaaaaaaacttctgaaattatggactcattttttgtttatgtctaaacgaatgaaaattttacgaagtatcttacagttgaactgtttacttgagctgtaatacttgcttcaagtacaaactgtttcactgctgtatgcagcatctgatttttccagaaattgttaactctattctgctttcgacacccataacaatttttatcaaaagctaattaccgattgaaaccctacttaagggttcaataaagatcgaatcacaccaaagatctcctcaatttcacctcactgtgacccacgttgtcgcaacaaccgagcccgctcgcaatgcttaccattcctttctgctagatttcccaacaaacagtatcagaactagatcgccactctgactgctttgccatgttgcttacaattgaaacgtccgttcccacattcataaataattctttgaaatcactcgccggtggctatcgcggcccaacgccacattaataacttgccctctaactgactgatttgtaagggtctgttcttcgaaactcgcgcacaaattatgactttccgacaacccagggcaaatgtccattaagtacctatgtaccaacgattttgtttcggtcggttctggtcggaccagagtgggccaagcacaaccggcagcggatgacggtttttctcaccattatcgcgcttcaattggtttcgctttcctttgcgcaaaaagacaacgcggagttgatcaacctacttggcttaatgttagtataaatattcttcgagtacttttagcgtatctaatctgaatggagatacagatgatggtttaacgtccgcttggctaggttgcaaaccatttatgtcgccagagtttgcgaaagcatgatggcttggtttaaaagtagctcccacgtttataaatggacaataggcacaattggttgtttccagctgttgaaagcttgtctgcatctaatattacgaataaaatgcagcgattggaagactaatgagaaactttttttcccttctccatcatcaggtccgaaggagttccagtaccgtggacacaattatttctacagcgctcacgtgcccgctcttgccgataaacgagtagactggttggatggccgcaacatctgtcgcgagtactgcatggacctggtgtcattggaaacgcaggaagagaacaatctgatcttccgtttgatccagcagaacgatgtcccatacatctggacggccggccgtctctgtgacttcaagggctgtgagaaccgtcccgatctggaacccaagaacgtctacggatggttctggtccaacaaccgtgagaagatcccagctaccaacaagatccctaacggctggggatacaacccatggagcaagtccggacacaagaagattccacagccagacaatgctgagtttgacatcaaccagacgaccgaatcgtgcctgtcagtgctgaacaacgtctacaatgatggcatcggatggcacgacgttgcttgctaccacgagaaaccagtagtgtgtgaagattccgaagaactgttgaactacgttgctgccacaaacccaggcattcgtctgtagaatttagtataaacaaatcttctagcattaagtgcctctcctccaaaactcaaaaaacaaggatcaaaaactattttgccaagtttttcttaccttcagtactgtcccagtttttgcaaatgaagcaaccgcataacataatttagggtacgatgactccaccgcatgcaaagcgacgaaccagaccaactgcatacaaaatcaaaacgacaaacacttcaaaatgttattcaaatgtatatttatttaatgaatagagttttttcgtacttctctatcctgtaatttgctaagagcgaactgaagtgcagttgaacacaagtggagtcccgattattaccaataaataaaatgtgcaaaaacggaattgttacagtgaaaaccaacaacagtgtaaaatttatttcaatgatgaccaaacgctattcctcttgctaaattgctaaatgcatttatgttcgtgatacctcctgtaattattatcgtcagatatcacgcttcaggacagataatatttctttatgaacgttttccgactgttccaaacactgctggcatagcaaggattgcaagctcgttctcaaaaaagcaaaagaccac

SEQ ID NO: 196 - DNA, 200382 bp, Aedes aegypti
  misc_feature (6355)..(6454): n is a, c, g, or t
  misc_feature (21098)..(21197): n is a, c, g, or t
  misc_feature (29330)..(31522): n is a, c, g, or t
  misc_feature (60721)..(60829): n is a, c, g, or t
  misc_feature (67544)..(67938): n is a, c, g, or t
  misc_feature (113150)..(113633): n is a, c, g, or t
  misc_feature (131124)..(133130): n is a, c, g, or t
  misc_feature (180254)..(180573): n is a, c, g, or t
ggcacaaagtgtaaactggcggttaactgagtaacagagagaaagcggatattctgaagaagcgaagaaacaacgcaaaactaaacccaagtgcaaagcgaccccccttctcgaacggaaggatccaagggagcgagagctacgaatttgtgattgtgtgttaactagcgaataagtccccaatctactacttaagtaagggtgtatggtcatttttagaggcataagtggaaaaaatcatagtttttacccgttaagaaatttatagtggtagcgctttagcactgttttaactgatctacactcaaaaaaataaagaaacaacgcgtggatccctgtgtgtgatagtgtaggattaagagataaacgcacgaatccaacgtgaagaaacccaattggcaaaccgagaaacaaaatcaagaatccgtcctcgatagaagtatagattgtgtgttttagtgcacaacagcaaaacgagcaaacaaatcaaaaaaaaaatcttaaaagttcaataagaaaaccacacaccgaccaacaaacaaaacaaaaaagtgagaagaaatgttattagacatggatcaccagaattcggcagtgtttatgtcgctgaacatgtcacagtactcgatgatcaacgactcgaccagcccgccgccgcatggtggcgctggcaacactacaacgcagctcctgtccctgtccggccagggcagcaacagcaacagcatgtccgccggccaaaccatgcctccgccgcaatacaccggctatggcatgtccaccggagtctcaggctccgccgggaacctcctcggggccgtcgtcggacacctgaacaacaacaacaacagcagcagcatcaacaacaacaccacagcgataagccttacatcacaatcgccaatcccgtcgcacaacaacaacaactccagcaacagcaacaacaatcatcatcacagccaatccggccagtcgggaacatccgtcggggttcagcaagcgcagcaacagggcctgcagtcccaggcctcggccaacagctactcgctctacaacttcgattccccttacatgttctccgcaggtggctaccacgacaacatctcccaaacgcagtcgaactatctcgcgatccccccgtcaggtactaccgccattgagccgaccagtctcaataaccttaatgtcgtatccgccattcaatgcgatcaaactgattttaaatatttcattgaagaactgtgcccggtgtgcggtgacaaagtttcaggctaccactacggactgctgacgtgcgaatcgtgcaagggcttcttcaagcgtaccgtccagaacaagaaggtctacacctgcgtcgccgagcggcagtgccacatcgacaagacccagcgcaagcgctgcccgtactgtcgcttccagaagtgtctcgaggtcggcatgaagctagaaggtgagtacctacccaacttttttcatgtttaatgggtttccgaaaaattttgttgtgatgaatctagatggggactcggcgtgagggatcccgtatgcgtggggactttggactttgctctaagtttcagtaaaggagtaaacaacgagtgatgctcggttggcgcaattgcgcgatgttggcttatgtgtaggggaggatgtgattttatagttttgcgttctcgcattaagtattacggaacgcaaggttttgagtccccttaaaactgttgaagatagactatcaaataataaaactctatcataagaacacctcaaactgttctaggttgagcatttatcgtgcgcatttgttaaaaaatagagcttcaatgtgtcggatgagcagtcaaaatggaccttaataaaagaggaaatctttgaaaatgcttttccgatagtgctttgatccaacaattgctctagtaatagctcttccccagaaatgtgactcaaccttaactgaattgcttaaaccttggttgcccagcgatgagtttgaagacccttctcatatctggctcgttgaatgttctgccaacttgaattcaaaatagctatttattttttatgctaatatttcagcttgattatttattacttgactttatatctcttggagattgaatatccgttataaatgttctacacgtgagtcgagcttgcgatataagtacaaactgagtttattcaatgttcagattattttaataaaatttcctgttcatttcctcttccatgtttttctaaactatttgggagacaaaactgaattcctatcatgtttaaaaaagcagtgctttgattagtcaaacacaatcttactcaagcatatgctggatttttccaaaatacgtcactcaatcaaggaagcggtttacacagaatcttttgaaaaattttggtcaggatcactcactgaaattttcacattttttaaagaaatagtggggtaacattctaacagaatgttggataaaattaacacaaaattctaagcataatttcacagagtttaccactgaatctgggacgaagatctcactaacttttggcagggtttcgacataaatctgagaaggacttttgtgaactaattgacagcatccccatatattctagtacggaatatgtatatgcgattctgttgaaattataagcacaatattgggaagtatctcgaaaatctagtacaagattgccatgtactacgcccaattttgggtcgaattcgttaagaatgtatgacagagctctgagtatgattctcataaaatcctaaatatcattctcacagagtcctgagctagagtcggtcgtaactctgagtataatttcacaagattataacttaatcctgggaaaaattttcacagaatcctgatcaagatgctctgaagtatttttttttcttttgaatatccaaagcttaaaaaactatcgtttcatgatggtccttatataacattgtttctaaaatatggcccgcgcttcgaaaagatttggcagaataggaaaattctactctgaaggactgatggttccaataaccgagagaaatgttcacaggatttttccaaagtaaggatttaagtctcgtagttttgatattaactaggcttatgctgtcagttactgtccgaagtaaagaatttagacataacaaattatggttttcttaatatgtaattattattttttggaaaaactcttcagtgaaatctgttttctaccggtggacagaactttccagagtcttttaacgaaaacagctcttgtaaatgtcttcttatcttggaaacatctggaacggcttttcggactgaatcttttaataaaaagagcaaagattgagttttatgtatgcagtttggaaaacgatcaaaatcttgttatcaaacatactttaaatatgcttcaaacctccaaagaaatcacgagaaagattcttgtttatcgaaagtggttcgtacgatttcaaatcatcgtaaaaatgttactgaaaatagtttcagaaatttatttagcaatcaaaactggatcatattgatcaaaacgatgttttgaatgtttcaaaattcaatttttatactgaaactccttccaaatttcataattcgtgatttcttcaacactgcttagtaaaactaagattttttgagagctttttattttttatttttttagtttgtttaaattgtcaacagaaatttccaatataaataactttggttattaagcaaattttgtttggccaagacattcttaaaaacttgttgtctcaagcctaatttgctgctgtaaaggaatcaccaaaaaaatttctggccgattccttgcggaatttttctacagcgattcctgtttgaactgacattttttttcaactgcgtactttgatcggaaaaagcacttccttacaggaatttaccatgcatctagatagtccaagaaattacttgtcatcagcgcatcatgctctaagctaggtatactgttcttctcaagaaaactcaaaaaattctgcccaagaaatggtcaagaaatttcctacagtgagttccatttgaattgacattttcttccaactgcgtactgcgatcaaagaaaaatgcttttttgagcatttcttgcaagaaatttcctacgcatccagataggcgattacttttctgttgaagtgcatgcttcgctttagcctttatgtgagaagccatgtaactttaccttaagtcaagtaacagctcaagtcaaaagaagcaggataagagtttagactgctcaaatttgctgcagaatatatatttgttctcggcaaaatgtttgttggaggtgcttttgtttcgaaaccttgtaaatctctaaaaactcttggagtaggaggctgagatcaatttgaactcgatatggcatgcgatagttggattttctgggaacaattgcacaaccaagaaaacctaatctctagatataatctgacaaaatctttcacagaatgtctcatttctttcttatagaagatttcgagagattcttcttggccttgctacaccaaaatctccaggaactttcaagcaaatgttcttggaaaaaatctcgtatccttgcaaatattataagtggaatctacaaaacactacctaggtttattttgtagaatactttgattaattcttaaagaaatttctggataaatttcacgagtcatcaataaaattttgaaacaaagtaatggaaaacttactgttattatctattagaaatttttaaaacgctccttgaacaattgaaatgagaaaatttggtaaatctgtcttttcttccttcatatattcttcatacatagtagaaagtttcactggtataaaaaccgcagaacttttcttgggaaactcctcaaaataacataaaagaaattgcattcgtgaaatcctgtgaaattcaggaatcaagatggaatttctgttgaaatttatgtaaaaatccttgcatttaattctgatacaactcttacaggcttaagagatttctacgaggctcctacacaagttcttcagcaaatctttcacagtttcagggagtcatttcttcaagaatactttcaggtgtactctagacctttctcaaagattcctcccagggattcatcgaaaaactaccttcagtgatttcacaggggctgcttgaaggaattttactaaattttacgtcagtaaattcttcagtagtccatcgttgataccgccagtaatttccaccaagatttctccaagaattctaccaggcattctccaaaaactcttccagagattcttccttcaattcttcttccgatttgttacaaagatttctttggatattatcctagtaaaactaacaaatttcgactccaggggttttaaaagtatcttgaaacaaatgttataggctcgagagatttcgacgaggctcctgcacaagttcttcaggaaatctttcaaaaattcctcgaaaaagagccatacagttctcgagagattcttcccagggattcgctccaacgattacaaaggggctgcttaaaagaattacccaaaactttacgtcaggagattctccagcagtccattttttgggcaaaatacctctagtagtttctcctttgattcctccaagaattctactaggcattctaccaagatttcctccagaagctgttccagtgattcttgcataaatttttcctccgatttacttagtttttatactacgagatgttataaagattttcatgaacattctcctagtacactacggcaaatatttggcttggattgatttgtcagagttgatgtttgtctgttgatttttgctcagccaaatatttgcacatttggcaaagcaaagcgtgtaccgatagcttaaaactaacaaattttgactccaaggtttttgaaagtattttcgatagccacaatactttcagaaaccaattctagaccctcgtgcaagagctaagcagcttctttgtcagatttccgtttagatagtaaaatatgcatgtgcagggttggtagaagtattctgaagaaattcgttgcgggaatttccagcaaatccaaccaagattcctgcagaaagtcctacgtcctaagtttttcagcaagcctgcagttttcacacgaatagccataacatatcatcacagattatctcaaacactgctacacaagttcctttatggattatttcgattattacaccgactcctgaagaaatcactcttaggattcctccagcagattttccaggtatttctctagccatttttattcgtgaatcctcaatcatttcgcttcagaatttctccagttactccaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagcaggcatttacacataaattattcaaatccggtgaggaggatatctctaccaaaaaatgctaccctaattccctttttttgtaccttttttgattaggggcgcctagcaattttctgggatttctcctaaaataatggtcagatgtttttcagggttttgattggtgcctttcccaataattattccagcaatttatcgaaaacattgtttgagagtttttaagtttccagaatttccaccagagattcttgcaggtgtttatcagatatttctttagaagttccataatgccaaaaagacaatcacccaccttctggtaacgttttatgcaatgaaatactactaattttgtatgaggtgtaacatcatgaaggcacccaccccttcagcgttatgaaatttgtgaatgggtccttaatcagaaatatatcgatgactttccttatttgttctaccattccttatattgagatattttgaagttattttctaggagttgttcttgaagttctaattttataaaaaatcatttttttatggaaatacctgggaggaaatttctggcaaaattttctggagaaatcataaaaaacacttatagttgtgcctgacgaaatttgacgagaaatctccatagaaattcaaataagttcttcctcttctttctggcgttatgtcccaacaaagcctgcttctcagcttagtgttcctatgagtactttcacagttcttaactgtgagctttctttgccaattgaccagtttttttgcatgtgtttatgtacggcaggtacgacgatactctatgtccagagatgtcgaggaaatttcctttacgaaaagatcctccaccggtgggattcgaacccacgacgcaattttcaattttgaagttaaaccaagaaacaaagcagagattttcattttataagaactctggaaaacgcgttcacctagaatttttctttgaaactgctgtaaatactatgggttattttgaaacactgaagtcaaagttcttgcaaactatttttatggctgagaatgacccacaaagtccaagactatgaaaataaatttttgaaactaaaactgagcttgacataatcctgcaaaaaaggatttcattggtaatacttctaatagtcatttgaaaaggcttcagaaggttctgtgtagagctcggtgtttagcagagagtcagctcttttttttgcttagcgtcattttacgattagattggaatttgtttgatacctataagatttcaaatagtgtattccataccacaactagagctttcgtaaggcaaaaactgtgaagaaagttcaaaaattcttgaagtaatgagaaagagttttgaggatgcttttagaatttagaaactgttttagaacctgaatctgaaagttggaaaacaaaatccaaccaaaatgacatgttaattttaattgcatggtttcataactggaatcaaggttccttaaaatcaaaattgtaactgaggactttctggttctgaggattttctgatttccaaaattgtaatactctgaattgttgaacaaatttgcataatgctttgaaaatcgagttatttgtgcttcataatgctgggaagcactttaacgaggagccaaaatttgttctaaagcttgaaaaagagtcaacctgctagacgacgttccaaaaacttaaggaaataaggaaagacatttttcgagaatatgctatccttattcgaggaatatcagccaatttccagatcaatttgtttcaaaagaggctccatcatgaccttgaaaaatagcaaatacaagattcgtcttcgatacgtcatatcgtgaaaacgtatgtaaaagttttaaactgagcatcccaaatcatctaaatcatttaagaatacgttgttagatacattttaaagacctaatggaaaaaagtacttcgaagatacaaattctcaagaggcttatttttacgaatattcaagttcttccaactgaaaccaagatcaattttcagcaaaatggatgttttatagttcagccaaaataaggtgtaatatatttttattgaaaatatttcagttttgaacgataaaactaccattgaagttttgatgataaaactggattaaggaaagttttcatttcctaattgttctatgatgcctcagatttatgttatgcattatcttatatgtaataataaaatgattttccggaatcggaataaaagcatcgattgaagtactctaaggtagtttaattgaaaagatatagactgttaattactttcgaaatattctttgtagtcaaaaaagtactcatgcgttcattttccgtacgattatttcaagcattatgtttcaaaacgacgtaccgtcaagctaccattcaccgtgcatttaaaaaaaatttgcacttcaataaattgtataacttttccaaataatttgatgcgtactagaataccactacgtagcgtgcaattatataataattcaggaaaaaatataaaaatagtgttggataacaaaaaatactctaaatatatgtttgaaaatgtcatgttaaggtcgcctcgtaccgttctatgtcaccatttaccgtgcacactagtgcaccattcaccgtgcatatagttttcgtcatgatttaattttgtatcttgaagaaacgttggtaatggagcaactatgttgctagtagtgtgcgcactcatttttaagagcattaaaatcttcatttataataaaaaccataaaaagtataaaaatttactaaataaatatttttttattaaaatcattataggaggttggactgtattgtccaaaccatttcatattcactcaaacactcaatatgaagttttttaatcacgacataacaataaatctagtattaccgaataattttaagctttttacagtaatgcacggtaatgggaaccatacatattgcaaagggtccatttaccgtgcatttgggttttgactgaaacacaagaaaaaatataaattgcataaaatttcattgctcatacgatgaaatacatctaactagtagtatccacagggtaaacttgttgaaattttgaaaaatttcatactctaacgttaaaatgaaaaatggtaatttttggcgtttctactaagagtgttgaaaaatctcattatcaaacagaattcatatgattttgactacataaacaaggtttttcaaaatgctttgtgacaaaaactacttcattttatcagctttatcttatattgctgacaaaagaataatttgtgaaaattgtatgaatattctgtaggaatttgcatatgtgcacggtgaatggagcccgcacggtgactggtgacttaacggtatctatccctcaaatcattttcaacatgcttttgcatatttttctggcgatatttactataagttgaacaaaaggaaccactattaagcaatgccgatatgtgttcaatcaggttggaaaattaaagaaatcatcaaataaaccccttttgctttgtgcttgtcacatgcatcatgatgattcgtcgatatcgtacctttattgttacatacacctcgattgatgtgtcagtttgacagtttgttttgcactgaaatgtcttcttcatgacatataaatttgttcaacgcataagtatcatgaaagctgtatccgatatgtctaccgaaaatggttttcattgtcctctaatagtatgtaatggaaaacaataaaaaagagttatatttcagaatcaagtaaaattataagagataagatttgcaattgaagcctgcaaatacctaaatgtcaccgtaaattatagaggagagatcccttggagatatacgtgtcgtcttttgaattctcgcgtaacttttcgaaagggcctatcaagcatcaaggattttttttgttaacttactctttaatctattactgagccgtagtatcgtcttctgttgcgttttttgtatgaaacattgtcttttgatttacctttcaggagcgactcctatcctcgttttgtacgtacccgacgactccattattttggtaaaattaggtacaaactcataccaagttattcgacctttaaaatttcactggatgtgtcgcaaacgaataacaacatagaaatcgaaaacctttgtttaatattccgcttatcaatatcagattcacaaaatgtaatgccccgataaactttaaatgattttagcaaatatcgaaacaaatgtgtcataacttgcgttaagtcacttactatatccaaatgtactcccgtgacatttcgtccaaatctacataatccgcacacctatgattccgttccggtatggtagcctttaacctggcagacaccacaccgcgatgaagtaagcgattgggtaaggcttgtctctatcctcgtaatctcctcgcccctaatgcacacgtttaagtctcacaagacaaacgtctgaaaagaaagaaaaaacctgcaccgatgaagtctctcggtgatccggtgaatggatcgaataagaccaccaatccaccatcgcctaaatggggactaactaactagtgagggttgttaaaattttcggcgttgttgaaccattcgcgcgaaagatgaaagacaacgcaacgcacggagaaggattgagactaaaaatttggcagggcaatctatcttgtcacagtcgccgtcgccacgcagacagtggtcttgatacggaaaatcatggcaaaattgcacattctttagatttttctcaagttttgaccatgacagttggtttccatcgaactaaatgttaacgaaattgctgttttcatactttaagaaaaaaataatttttaagacatttgctcatatttagggtccaaacatcaaacaaaacaattttctcttgaaattatggtatgtgtttttaactatctgatattatagataaatgtgtggtcttgttcttttcctttttcttcactaggacagagcttgcttctcagcttagtgttcttacggtctcttccacagttattaactgagagcattctttgccaaacttgccagttttacattcgtatatcgtatggcagctacgatgatactctatgcccagggaagtcaaggaaattttcattacgaaaagattctggaccgaccaggaatcgaacacagaaaccttcagcatggctttgctttgtagccgcggactctaaccactcggctgaagaaggcccctaactatctgatattgtagatgaaattttggccttgttttcaactacaaaaaacttgttcaaaaatagagtttcttaagatttctataaaactgaaccgctgtgcaccatttcaccgaacttggtctctggatgtctgttttttgcgtggcacggagtgtcgggctctggatggacctttctcttcttgcttggcagacatcgcacaacaaatggcaaaaagctcgcttcatcagcacaacgttgttgtcgtagtcgtcgtcagctggttgcgttgcggatgtttgcccatttttgccgccccgagaagtgatgacgacgactacggcggaggaattcgcatttttcggacggaatttttgaaagtgcacatgtggtgagctgttaccgggaatttcgggaaggttttggggcggatgcagtggagagtcctaaaagactgaactttgagtcgaaatttagaatttttcgattggagtgtccggaaactgtttcatctattgtgttccatctgttaccaagcaatgttcatttaatttccagcaaaattttacattaaattagtcttatttgataaaccttggtctaccttgatcaaaatacagtcaaacctccttgactcgatatctgaagggaccatcgactcatggaaatatcgagtcgtggaaacaaatttattggaaagccgtttgaggggaccatcatagtaaccatgaaattttgtttttagtatggttccatgagtcgatatcgagtcatggaacatcgactcatggaggtttcactgtatatgtgaaattatcatttcatttgtattcaaacaaatcaaaatttgttgttctaatattttacattttgtttaagtccagttggcccagtaaacgttgtattatctcccagtaggtcgtcatttttgctaagaagactcgcatactgaattactgctataatttcactcggttttacaaactttcccagtaaatttcatgaacttttagttcacacgagcacgaaacaagaggaacaggaagaaacgaacaggtattttgcttacgaacgaaacgaaggaagaatcatccatatcttttggtccgttctgaagctatttcgtgacatacaatcaccatcccattttttatgatgtttttaatagttttaaggaaaaatagataaaccggcaaatatgcaacttcttacattcattattccggggattttcactcacgattttaataagtgaattgtatcagtaaaggtaaatttgtcagataaattcatttccttttcttctcagaataattaattttattgacctttcttttatctgccggtatccactttgtacagtaattgaaaaatgtaggaatatgaaggataagccgatattactataagattgtcacgaaaatcaaattcattatcgaaatctttaacactgggctagttcatctggggaccaacttcccttccgaaggaagtcgtcactataattttcttctttcttcctctgcatgagaggcgtgtgttctaactcctacaccaggtccgtccccaacttcagctaaatattttgttttcttaaaatgacgagatttcagaactgccctcagaatttattaaatttctcttcgtctatcaagtgttctgcaaaaacaaaaatgataatgatagttttttttttatttttcaatgtgcaattccaaaacatttttccttaatgttcttaatgttttcagattgtgtgcgtatttagttaatatttatacaaagctattttctcttacgtaaaattacgttaaaatatcctgactacaacgtctcgatttgttcttctctttgtttttttgcaaagattttcagtggaatcatctctaaatttttactaaattatctaatattaaactaaataatctaatatacatttttaacacctctgagatattttttgtcatctcaatggcaagctttttttctgaggaaaaatataataaatcatctaggtttcactaagacaatctttcacgtgttaaaaacatgaaagtttttatcagatttttgtttaaaacctcattaaccggatcattgtatacaacctcattaaccttttgagttttctctatatgtggctgatcatttctttaaaatattttcgggatcaaaaggaaagttttttttgtgaaatcatattaaaaattacaattttattaaaatgctttgtaaatttttgtttcaatttggtgggaatttttttttcaatatcacactgataattttctttaaatatggttgaaatctgaacattgacattttttatcatgttcttatttgatacttcggaagtgacacgggaaataaaatacatcgaaaattagagtttaaaccaaggtgtgtgacgaaatctcaaaaactatttctatttcatatccgttggaaatttctccgttcaacccaataaactcgacttctttttgaatcaactccttgaaattttacaaaaaaaatattcaagtttgcacttcatcgcaaaattatatacaaatctgctcgatatttcctaaaaaatctttgagcatttattttaatttttagggcatgtagccttactctacaatttcgtttttttctgggatatttcgccaaatttaatggtaatcttcaaatctatttcttaatgctataaagctcaaaacattctgaagaatttgtatctaattttaggtattatttctgttaattttaattaaatgtcttctgaaaattcagctggcaactttttataataatgtcttgagaaatttcaatttgaataattttattgaaatattttagaaatccattttgaaattttccattattttctataaaaccgagttttctaatttccctaaattcggtaacagttttttttttctaaatacccgtaaaagctacaggcaacttattatgaataaatgacaaaaagtcgaaagacaaaacattaaaaggacaaaatatcgaagataaaaaagaaggggcataagctcggggcttactttcaagaacgtagaattctccatgtagctaataattttcgacctttttttcgaccgtccgtttgatttgttgtcttttgacttttgtctcgtttggaatctacggcaaaatattgaataggaaaaaaatggacagatcgaagctccaagattttgctagaggttttttttaattaccctagaatccgttaaatttttttttgtatacacaaacattcgaaaaaaaaacttctaaagaacaaaaggttgaagaaaaaacagataaggcattagtttgaatcttatttccaaaaatgtgaaattctgcatctggctaacaatctttgtccttgtgtctttcgatcctttgtccattcggttttatatctttcaactttttgtctcattttgaatctatggcaaaagattgaaaagaaaaagatggactaaagatcgaagctccaagatttcgctagaggtctttctcaagagttaccctaacattcggtaatttttgttttctgaaaacctagaaaatactaccggcaatctctcataaatctatgaaaaaaagtcgaaagccaaaaatttcgaaagaagcaaaggtataagtgaaaaacgaaggtggaaaattttgtcaagaatgtagaactctctatctagctaacaattttcgaccttttgtcgttcgaccttttgtttgtttatttttttgtctttcgactttttgtctcgtttcgaatctatggcaaaagattggagagaaaaaaatggactaaagatcgaagctgcaagatttcgctagaggtctttctcgtaaattacactgaaatccggtaaccttttttttctaaataactagaaaatgctaccggcaacctatcatgaatctatgataaaaagtcaaaagacaaaacttcgaaagaacagaagggcgaaacgaaaaaagaagggatattagttccaaacttattttcaaaaatgtgaaattctccatctggctaacaacctttgtccttttgtctttcgatccattgtccatacgattttttatctttcgacattttgtctcgtttggaatctacgacaaaacattgaagaggataaaaatggactaaagatcgaagctccaagattttgctagaggtcttttttaagaatcaccctaaaatccggaaacatttgtttttctaaatacctagaaaaagctaccagaaatctattctgaatctatgacaaaaagtcgaaagacaaaactttcaaaggacaaaagttcgaaggaaaataagaagggtcataatttcaaacttttttttaaagaatgtagaattcttcatctggcttacaattttcgatcttcgaagattttgaggagcaaaaagagaaactgttttttttctgaaagaggaagaatttctcaccaagcatttacgaccttctgtcgttcgacctattgcaggtcggaaagggaacatgtgggtggaacagacacactgataaaaatccacacgctcgatctgtgtgtttaaaattatggatcgattcatgaacgtccatatcgatttgctatgattttcttgcaaacttcgtgtgtgttacacattaaattcctttgttttgcttcatggattgattcatcaaccgacaacagggattccatattttttccacatgagttcccgaagctttctcttcagattcgtatgtgtcaacctatggacgcatagatcatcactccaacacggattaagtgtgttttgcttatggttatcttgtgtcataatcatcatgttcaagttggtcgattcattgatttgcgcaatgagattgttatgatgaaatccatgagctatgctatcgatttccatgttcaaagcttctaaattgtttgtgatcaacccatgggatgcatagtgaactgaattgcggttgaacctcgtgtcgaacgacagtcatcatcatgcttccaaagagaagaagcaaattctgaagctgaaagtgttagatgaaaatttgtgaattcgatttttcttttattagtgaagttgatcgatatacgagaattctacctttctataagaaaacattgattataatgtatagtttagtagaaaaatcggattccactaacagattttcctggctttcagtttcgaaaaaatggaatatgcttatccctggcttcccaaattatggatttgcggcgccccgcttgatgctggctcacgggtttgaaaaaaaatcaagagagctagcagaggagcctcggatccatattttggggagcaaaagttcttctaccaaatttcttctttcagtcccatgacatttatgttctatcacacatgactatctaaagctactacatttcgaattcaataagcaaatcagttggttttcatgatttaatatttggaaattcatgtttgtttcacatgacaacctaatgttgatacacatgttattataccgtgaaatcaatgatgaaatccatatggctaccacactcaaatcatgtggttttgctcattgcgcaaatctataagtaaaacacacgactttgacgtgtagatttttctcagtgagaagaggagtttcagaaattgatcacaaaaatttactttgagggtgttgatatctagaaccggacatgacagctcaactagctcgataatcttgacgttacaaaggccagtgctgtcagtatccttcttaaacaaatctagtgaaaataatcaaatgttaaggctcataatttggcagttacttgcacacacatttcgttcagtgcaaaagaggatactggcttttcattaaaattagatttatattcaaaaccttcaatattttttagataacatttacacaattttcattatattgctctcaactaaactttttttcgttttgagggttagatgcatcgattatcgaagccaaaactcgaattaacaagagcacaaatctagagaactagaaaaccgtttgtgctgaaaagttatctcaatggtgctgaaaatttaactcattggtcacttaccggtggtgaccagtgagctaaattttcagcccaaacagttgtctatttctctagatttgtgttcttgaaaattcgaagtttgcattcgatgcatcttcaccttaatcattgttggagcactggatttgaaacaacaagattttatgaataatttccgaaaatttgataaaagctctgatttacgaactagcaacacggccaggctagcaacaaagtgccctgttgtaatcgaattcaacgatgggaaagtaggcctttgccaaaacgaccaatatgaaatggtcatttttgacgggcaattggtttcgagtttagtacttttatctggcgcgtcatgtctcatgctgatgccagcaatatttaactatcaaggttacgttatattcctggcattttatagcattgcttattaatcaagtttgagctaacttattgaggattaacagggaaactgaagtgagtttgcttcatcttcttcttctgcaattttcgttatgtaaaagtagaagattttgtttgtatttaaattgaacaaacatgagaaacaagagtataacaaaattaacgacttagagaatgaaaaaagagtagtttgtgtttgggggaacaacagagatatgtacctattcattaatcgttttccataaatgttttcaagcatattcttccacactgttttaaaactttaaataaatttacttcttattaaacttaatacttatttttggtctttttctcacttttttatcaatttttggtaatttatagtttaatttgtctctttacgatgaatcttcattacaatatgtacttcttttaatttttggcactttgaaacttttgagcatgtgtgacgttcacttattcgacaaaaattttaacgccggggttgttcctatctgacattttggaagggacacggaaaacaaaaaacgcccaaaatttgagtttggggtgcgacaaaataccaaaaaccgtaaaaaatgttttttggacttaagctaacgaaaaacatttaaaaagttagtaaacaaatgtttttggccttaactcaagcatattgtactaactattctcatcctcccagcaccaaaaatccgcgatcccattcgtctgcaaccggacccaccgaagaatgacgtaacccattggggtgctgcgtgttccactgaaccagtctcgcgatcatggaggaacatacacacacaatacacctagccttaaaccccgcgcgacataaccgaaatcgaaagtgaaactccccctagattattattgtgcggcggcagcggggaaggtgcccgcagtaaattaacacccacctttcttggttccagtcatcgtcgtcgattgacaaaaggcttctcttgcacatacgcgtgagacttggtgacaattgttgtcgaagtcgagactccagcgaagaaagcgatttccccaatctcagagccttaaatggaccggtttgtcaacagaacttctttcgtctggttgtgggatcttgttccacgtgcaatgcgtgactttcaatttgaaagtgaaatgattttatttttagacggatttgttagcactgcatgtcggtagggatgtcaaattctggaaatgtttttgactactaagctgagaaacaggttctgtttcagtagggacgttagcccaagaagaagaagagtctatcaagatgaaccctttgctgaaccagatttatgatcaaaaggttaatcaaattcgaaatcgtcttaaacgcagtactatccagattgtaattagacgaaagtcaggttgatcaaatgtgaaacagggcatacagttagaaacaactggcagagtcacgttactgttcagttttatctagataaaagtacagtttgactgcaatttcgtctcaagaaaattgaaaataccaattagcaaagagttggactttattttcgtctgtgctcaagcgtcctgcatccttacggagccgaaaccatttccggttcgtatcattctgatcggatcgccgttacgcaagcaatccaacactcaccttacatgcctcaattcgcatgcttcggtcggcaacgccttaccccgctcagaagaagaaacagacccccgaaaaaaagaggtctttctctcgcacttggtcagctggtcagagacggctggctgggctggacgctaaaagccaaccgaacaggtttgttttgtaatcaccctttcccctcagaaaattcggctgcttttcggcggccacataggcgtcgtcatcgatcaacgcatttcgtcgttttcgtgtgtgtcactttcgtcatggcgaatactaatatgacgacgaagtcgacgacggctaagctttttgggttatgttttcgggggaactactgcgggatggccatgggccaattattcgttacgttacgtacggggtacgtgcgggtctccccggatggaacaaagcacgcaagaaacaggtttcgcacgtaatcggcggtggcaggccgtgtgggaaagtgagttttctgggcaggtaccgaattagttttaccgctgggggtatttagcggtcggttaaagttgatggatcggggctggcggatgagttatttgtttatgaatggggagtcattagataaacaattcataactaaaatcgttcactttaatcttcattcagtaaaaattagttttaggaaaattcagatactttactagtaacatttgaggttttttttacaaatttaatgaccagaattttcttgtatgactagggtgttttatgtattttgggcagagcgttgagcgtaaataatttggagacctccatttgatttttccataaatggccaaattatatacgcgtaacggtctgtccaaaatactttgatcaccctatcataaaaccattttaaggccgcacgggacgtcatcataatcaccctgtccatttgaagaagaaccactctatatatcgatgcgaaaaatgtatcactatgattctatatacatatgtagggtatacaatacactttcagtttcatcgtttcactgaaactcgagatttgctgccacaaagttttgatgataattgttagagtgagacaaaagatagggaaaataacacggtctcccgtgtcgccttaaagctagagttgttcccagggttttgtgcttctcgtaactagataactttttgcggaaaaacaacgtagcatatgagattttattacgatctcaatggtcaacattttgttttatgacaaccttaaacccattttaaagctagagctgtagcctgggttcatgtgttgttcttttccagctaacctaacatgaaaaaataacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaccatagcttagttttatgattatcttaaatccattttaaagctagaattgttacatgtgtgtgttactcttttatgaaacaaatctcgataacttttccaaaccacactgttttgagtaaattatccataagaatcatatcttctaaatctgtttaaaaatgaaacctctttttggcatttttcgcattgtacattaaattttacatgcaatcaagctcacattaaaaaactagagattttcttctacatctcacataaattacattacattctattacatgacaaaatgtaaaatcggcttatgtagccttttttggattcgtggctaaatcactttgtttctctatttaacggagcgtcgcaagtaatggttaggtttcgaaatttgagaatctgacataagtcgttttcagggctgttaccacagacgcgaatttcgcgattctcgcggatttcgcgattctcgcggatttcgcgattttcgcgattttcgcggatttcgcgattttcgcgattttcgcggatttgtagcggatttggccagccaagcgcgaaaatcgcgggtggataaaattatgtcgcgaaaatcgcggattacccaaatcatgcggcaaaaattgtagttatatacatacagtcgtgatttcaaaattgggatattgctatttaaaacagaaaatccaaaaaacagttaatccttttcattttatttggagtcatttttctcgtgggtcgcttgtcaatcaagagatagctcatccctaaattcttaatgacactaatctaaaattctattctattgacggcgatctataggttcttgactttaagataaactggaaagagaaaattataccgttcaaatcctgtgagtacgatttttaacggaagataaaaatccttcaatttcatcttccgttaaaaatcgtagaaaatagcgctcattaagaccactcagcacatttggcttggctttaaaatatcttgaaatcagaaatgtgtcaaattactgatcatggatataatatgtcaagacattaagccgagtgaggaatgctaaatttgttcagcttgattacataaatgcatgcattcaaagtttgtacggataatatgcggacactctggctgagtgttggcgctgcagtcatagttggttacgttataaaatcttaggatcgatagaaaagtttaaaacaatagatagctccgtagtcaaattcgcaattttgtcagtgaagaataagtgttgtaaatctagaagatacaaataacttgaagttaatggaaagcagcactaaaaattgtatgtataattaatgtaatatttggtgtaaatataactaaataaaacctcttggctgatcactataaaaccgttttacgatctgctttaaaaaccagtgaatcaccaccacaacaaaccggttaaaaagttaactcctggtgaaatcgctcaaaataatagttttgcttggtaaatttttgttcagcaacaattttgtaataaaaaatggatcatttataaatttgtaactttggagaaaactgtgaacaccaacgtgtgaagaaaaaaataaaatgatatcaaaactactaatattttgagcgatttcaccgggtgcttaacttttcaaccagacacttagaaaaaatctttgaaatttacgtcatttgttcccgacatattgaagcaagtaaaatgacgtgaatctaagtcacaaatgacgtacttttccgtcacaatgaactgaatattatttgaatcagaaaaaaaattcagtcacattggacgtaatttaacaagaatgacgtatttttaagttttaataccatcaaatttacgttacgtacgtaatattagggttttctaagtatgcagtactatgacgaattttgggataatgaaattgaagagacatttagagttctctgtaaaaatttcatgcgttttgctcataggaaaacaaagttacagcatgccaaagttgagaattttgtatgaaaatcggctttcactactattattctgaatacaactgtatatacaatacattttcaatacttttgtgtaaaatagtaattaaactcagtagtttacaaaccaatttttataaaattttattgcttttttttgttgaaaatagcgacataatggttccctatctcgccatacgcaataatttgattatcttcaaattttcaatcattctgtgtgtttaagtagtttaatatcaaatatatcttgatgttgacacattaaaaaaattggaaatgtgaaagttttcgagaaaacacgtatggccaaataaggaatcactatagccataactggtacactttccctaagtaaggtctggttaacatttcatcaaaattgatttataagtggttcagatctgccctgtagagttggacattttgtattaaacgtcgtgagaattttaaatgtatagtctaatgtactgccaatggctaatgaatattgctgaaaaaaatgtaacaattttcataaaaacagaatattgttgaaaatattaaattatcacaacaatcttgtatttttacctcaaattggttaagtattaggacttgaagttttataaaaataaaaacagttttggaacaataaatggcatgcatttcaaacttattgtttaactaaactcatctcataaaaaaaatttgctagatttttttttaataatatgatggtgtttgcctatccatgtatttcatgaaaaataaaaaaatacagttggtgatctaatcttattaattgcaatctttctaccacttaaaatatagtgtaaagttagatgagacaaaaaatcgaaatttaaggttctgtatgcttttaattgacaatgtaaaattactgtgtgtgtttttctttttaagttatcattaataactacattttgcatctcctattgtatgcaaagacatcgaattgtgataagtatagttgcaaactaggcttcctctctgcttgtagtgacactaccatttattaaattgcacgattttttataaaaatatattgaaatgttgatgacaaattaatttcgagtgatattgttgaatacgattttctccatgaaaaactcgaattataggattttttcgctttttactttatttcctgcctagtggcgcaacttaagtaaattaaacatatttcataatttaactctacccttagtgttgatagaaatccgtataccaatttgtcttgctcaattgtaaatactttaaggcgaaaataatcgcttagtaccattaaaaactagtttttgatcaagcacgcttacgcattttttataatgagtagtaaatatgtcaatgaaacagatttttttgaggcgcagattaaagttcctaggcgcggatcgaatttctgaagtcgcgattttcgcggatacgattttaagatttttgtaacagccctgcgttttgtaaatccggaaattaaactttccaaaagtaaaaaaatcgagttggttctacgtaaaaaacagtagaattttgtatgcggaatacaagaatacaagaaatcgataatacaagttcttttgttattcggagataaagcagtttgaatgtttttttcgagaaagttttttttgttacaagatttcaatactttaccgcaatttactttcaatttgacgtaagtagcttctacactgtttaaaggaaaattattgagtagaattataacattatttctgaatctattgtcaactttctaactaattcattccaactttttaatttaacatgcttgcacgtgtcgaaaaatactaccacaaaaacctaaggacaaaatgatacatagttttttttcaatcaatttgttcaattgactcaagtagtgttttgttttgattcatggtaactaacggaaaaatcaacttgaaacaaccagattcttcttttatgataggatgattgtagaaaaatataaaataataattaattaataaagataggttgataggttgataaatatattgcaaaattatgaaggagacgtagataagaattcactacacttcggtgagatttacctttaaccataagaacttcttaattaaccaccaatattcaattttgtatgttttgaatggtggaaatgtcgagagaagtgttatatgaattataacgaacattataaacattgaatgtttgcacaagtaaatattcggtatgatacatgatactgaatatcacaaattagtctacaaaaccgtaatgaaactataaatctcgaaactctattcaatcagccgtaagtctgaagacaaaatgactgatcagtaaacacaaaaaataaaatatgtaccagtaaaattcaaaagtactgcaaaaacccatatttttattattggcggaaaattggtacccagtagaggcttcaagaaaaaatgaaaaaagatagggatgctcaaaaataaaaattaggaaatttaaaaaccaaaattcatagatttacgaacaaaaattaatccttgtccaaaacgtgtttagtttgcttttagatagcgaaaaatgatgcttagatcgaaaataaaaatttggatattagagggttaaattatactgtgattgatctcaccattgaagtatttttatttaagtgtaagggctagcagctggtatccttttagagatttgatcagtattttcacgcaagtttctaaaaaaagctccatttgtaagggatagtctctaaagtatcctttgttttttttttacaaaatagtctctgatgtctcatttttcctcttttagttcgcagtgagtcctggtgcaatattttataggctactgtgaaaccttcagagagtttatctcagattcctcaaggaaatggttctggaattagtcgaatcatttctccaaaaacttcttctggattactttcaagtacgccttcaggtgtcactgcatatattcctctgaagattccttaagcaattctctttgattcttagagaaacttctccagaatttactcaaggaaatcctgcagcactctaatgcttttaatttcaataatttcctcaaggatttctctggatcatcccaggatttcttgtacagatttttcctttatttcatccagttgtttctctaggggtttccaaatgtttctataggagttctaccagagatgtttctaataactttcccattgttttttcttcagttgttactttaggagatcttctacttattccttttagagttcttccgtgaaaatttcctaaagtttattccaagatttttgaggaaattcgtatagagatatctcaagaaaactctgcaaaaatttctccaggaatttctatgttgatttttccagaatttttcatatagtttcctttaaaaatccattcaaagtttctaccaggagttgctctaaatgttctttcaaggataatttcagaaaatctattaagaactttcctgggattttttttaatgaattccaccaataattcatcctgaaatgccttcagaaatttctctgagatttttttctaacaatttttacccaagaaacattccggcagttcttcaaaacagttcttgagaaatttcgcaagtaaagtttccatggattatttaaaaatttgtttgagatttaacaccagcaaatacaacaccaattatgtcttcctccgataattccttaacatgttgggtcctaaaatttttaacgaattcttgttttaatttataaatacgaaagagcatgttcttgcaactactttagcaatttttccagctcaaaaacggctatatcatatttaaattttaataaaaaaaatggttcaaaatatgaactttaacacttttgatcatgtttgacgttcacttcgtcgacaaaaatgtcacagggcctttagttttaacactggggttgtacctatctgacattttggaggagacacggtaaacaaaaatatacccaaaatttgagtttaatccaaggggtgtgacaaaatctcaaaaaccataaaacatgttttttagacttaacccaacgaaaataatttaaaaatttaataaacatgtgtttctggcgtaaactaaagcgtttggtactaaaattgggaaaggctttaggaacctattgcatcctatattttcaaagaaattctggaggatactgtccaaggattcattccatcttttttcaataattatcttagcactttatttagaaaatttcttcaagttttcctcaagaatcttagaattatttcagagatattttttctcttttattagtcagattttaaccctaggctgctgcatcgttctacatagttcttttagagatccttgcagatattcattaggaataactacaaaacttattgaggaagactttagaattccgtttagaaacacttcatggaacttctcctcgaaataattcctaaattggtttctttgagaacttttttgggaaatttctcaaaaagtttattgaaaaattttaaaaggattttccggcgtaattttttaagctagacttagagaaaaggtccaaatcggcactgggtcaataggcagaaatcgaaacgcattaggttgaaccgcatttgccgaaagggtcgttagaccaaatgaatggaaaatatgctctcattattaatcattctatatcacattttttacatttatcttgtaattagggaagggtttaaatgaagctgtactgaattataaaaaaaacccaattccagcatgagcaatgccaataatgtatgtaaggatattacatgaaagaacggcatatgtttaaaagaaggaaacatttcagataaaatgacagcaactttgatgccaaaagttagcttaatgaacaagaacaggctcatgttcgattttcagtgctgaacatagcttcattgaagataatatctcatgtagactaattgagaagcacctttatttaaatgaagttttttttcaaaaatggaataacaattttctgaataagtaattaaaagcttaaaaacaaatcattaaaataactgctccgattgagtttcgaaggtttcggcctaatgacccattcggcctaacgtacttcggtgcgataacttattcggcctacaggctttacctcattccaaaaaaaaaaaactttttcggccttaaatacttcggcccaacgtacttcggcctaatgccattcggcctaatgaccggataaccaaatagccgtagcggtaactgcgctgctattcagcaatacatagctgagggtcacggtttccaatcccaccggtcgaagatcttttcggtttgaaagttttctcgacttcccagactaccttcatcgtgcttgccacatgatatacacatacaaaagtggtcaattgggactcacttgataactgtggaagtgcactatcccagttataacgttatgccagaaagatgaagaagtggaagccatagaattttttttttcatttcctcagcgattactcagatttttccatggaactattcgaagatttcgtgtaaagattttttttccaacaactcttcattcaattttgtcagttagtactctaggagatcctcaaaagatttctttaggagttgtttcctaaaactccacaaggttgattccaaagtttctaaagattttttcagagatttttcctgaaaccccacaagaatttctaccgattttctacgccgattaagagagttttctgattactcttcattcatttatttttcagttatcattctaagaaatcttcaaaagatttctatgcgagtgcgagtgcgagtccacaaaggtgtattttaaagattctggagaattctgttttaaagatttcttcagaaaacaccataataactccttttgaattgtttacgtagatttcataggtatttttcttgttacttcgatgaagttcatttaatttaagaattaatttaaagttaaaggaattgctgaaggaacatcttcaagaatggtatcagaatatctatgaataccttctaaagaattttacaatgaattctactcctcatgcaatactttcatatttcacgagtttttcttccagcatttacccgggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagccatgatgaatgtgtctgggttcgatcccctgtcagtccacgatcttttcgtaatggaaatttccttgacttccctgggcatagagtatcatcgtacctgtcacacgatatacgaatgtgaaaatggcaactttggcaaagaaagctctcagttaataactgtggaagtgctcataataacactacactgaaacaagcattgaagtaatgagaaccatgaacaagtttttaaatttactattccaatcacgattgaggtatcaagaacgctttttatttgcgttttgttccctcttaatccaaccgcatcgatagccgagcggtaagcgttcgcgcttgacaatcgcaagatcctcggttcgattcttgcctgctgcaaattttcaacccatgatatagtcatttttactgtcgaaatggtgccatggtaaaattgaatgcacaaaatatttgaaataaatgcaaatttagtctgcacaaatcaagtggcgttgtgtatttaatttaaccctctaatatagtatttacaactgcaacgctgatctcagtgtacgctgagtagctggctctgtcccagtgtggacgttaatgcctagaagaagaagaagtgaccgcaaattagtcgaaatccctttgaatgatgcattccaaatcattccactgtccatcctcgatatcctcgaagccccagagaagccatcatccagtgtcctaggcgttaggctaggctaggccaggccaggctatcactttccggtatcgattttttgctatcctttcccatacattatcatcggggctgacgctgacgtcacaggcggaaaatcggaaacttttcactcttgctgcaaaacaacaaacaactcccgtcgcctttcctcctcgtgcactggacccccttcctttcctttatagcttccaatcaacactttaagcctcggagctgcgaatccgagctctgctgcgctgactgcagcaagcaagccaaagtaggggaaggtggttcaaaatgcacttttgggatcaaatggcctagttgatacctaaatgaaattaattatatttaaagtagaaaatacttgaaataacttgaaatttgaagtttaattttaatgttcgagctttcatcttttgctattgaacttcaatagcaaacttttacagaatttggtagtttttagtgaatttgtatcaaacacagatcccaaattaaccttttacatcatagtatttccttttcatgtttctagagattaaaaaattaaagtctatttcaaatctcttcgaatccccttcaaatacattatgacccccttcatttcatcatgacccccttcttaactttcaggttcagaagtttactaatgcccgagaagatttaagcggacacaaaattaattccagggccattcgaaaggttttccatgcaggctgatttttatttttatattttctctaaatatctctcatgtgtaacaattgaaactctatttcgaatccttttacaatgaaacagtttggagtctagcttctaagattgcactaaaacttcaaagactctaatctcgcgaagggagcatcctacaagaatggacgttttattttggctttgtgcagcttagaataagaatatcaggaacgtttgccactagtgcctccagcttagtgcctttgaaaacgcgagtaaagtcacaagccggccatctttggattccgagatgtttcccgctaaatccccttcacattcatttaacccctccccctcatccattatgacctcttgttttctcgccgtttttttcgttcaaaaactcaaattatatttcaaatctgtttaaatcgtcttcaaattcattatgacccccctacttctattatcaccccctttctaattcccttcatgaggttcaaggaaagtttatgagtgtccaagtgggtaatagaaggacacaaatttaattccagagccgcttggagggtttttctgtggggaggaggcacacttgaatgcagtaggagcgtaaggaagaaactagctgatttttttattccatctcaatgttccttatgtttaacagttcaaactctgttctaaatctctttaaattccgttcaaattcattttaaccccccactctcttccattatgaccctctgtttactcgccaaaaatttaatcccagatccgttaaaagatgcaaggcgtcgaactagctattttctatttttttcttttccacttgatgtccatcgtggtcaacaaatcaaattctactttttttttaatcctcttcaaatttattatgaccccgttttcaggtagggcatgaatctctcacgaatattcaattttattcctcgaggaaaagctcaaggttttcctccgaaaatttctctggaatacctacagagtccttaagggacccctcaaaaaatcttttaacaatcatctcaagatttccagagtgtccattcattcgggaaatcctggaaaagcgtaaaaaccccgggaattccaaacaaccgagaaatacccgggaattcggagaacacagcgtaggttgtgtagttgtgaggtcataaagagatagttacctatccctaaaaatatctagaagggtacctaggagttcctggcaagtttcttggtaagatggttgttagattttcatttagactcatggtaaacttttaatgagatctttgctagaatcttaatggagaccaagctgataattgatcagtttttcctaaaatatcactgaaaaattattagtacattgctaataaagattttgcttgaaattcttagtagactcgtataaattggttgaaaattaaaccaaagaaatatttaccatatttcttgggagatttactgaaatcttggacagattcatcaaatttctatgattattgatgaaacggattcttggcaaagccttgtctggatccaggagtttgactagttcctgatatgatgactttgcataaatttcagcaaatttaagacgaatgatttccattattccataattctcaacaagtttcttgtaaaattattcatgaattcatggctagatttttgatgggtagagaaatatcgaggtcctttaggtatcctttaccagatataggttatgtgctttacgaaattattggccaaatctttgtcaaatagctaggaacatgcaatttcttattaatgtccaaaatgttaggagaacaataacttatttttggagaaatcgtgtttgttaaagatatctctacttggatccaacatgagtttcaatagatcaagaatgtcttcaggaaccagccattggtcatgtctacctcttacttacgaaggcatcctaagaatttaatgggttgtatgttgaactttgccctccgtggaaatacattctaaatttagatatccggagcaggaatttgattatataattctaatttctctctgaactttctatcaattcaagaggttagacggtcttctaagtatttcaacaagcagtttatatctttttgtccaaaactcttttgaaattccaaccgtttgtttcaaagtattttaatgctgagaggacggacctggtgtaatggttagaacacacacgcctcttactccgaggatctgggatcgaatcccatcgccgagatagtcacaaaaaaaatcagtgacgacttcctttcggaagggaagttaagccgttggtcccgagatgaactagcccagggctaaaaatctcgttaataaatatagaaaaaaaaagtattttaaacttatttaaatcaagtcctccaaatttgaacatattgtacggaaatcgcatgctcattttgtcatcctttttttcaaatttctggcgtccgggaaaaggaaaacttgttttgattggacaccctggatttcgctcagaaactgctttaacgattttccaagagatgctctgaagaatttaactactctaactgtactcccagagaatattgtaggatttttttagagatttttccaataagctttcttccaggtttgccagttgttgttctaggatatgtcgttaaacttcttacaggaatttgtccaagtgaatccgcaaaggtttattttagaatttttgatggtattcgtttagtttttttcagtaaaccctactagatttctactttaacatcgacgccatttttttttcgacagttcttccagaaatttttgtttcttccaggaattcctctgcggattatcccaagaaatctattgaaaacatttccataaattcctctttgactttgactttgactcatgaagttcctccaggattacttctgcagttatttcaaacatgtctcgagttaattctcaagtaaaatctccatgggctcttcagaagctaatataaagattcacaccagaaagtactgcagaaattattgcagtaattcttctggtcattttcacactaattacttcaagaattccgtacatatttttcgatgaataccttcagaagtttttgcaggattttgttgattattttcaagaactgcttaagcagcttttcaaagcttgcttagaagatccatcagtacctaaattctactacctcaagtgatttccacagaactcttatagtttttccatgaactgtttcagtatttcctctacaaatttttctacttacttttcctccgatttctctaattgtagctccaggagatctttgtaagattcctacagcagttactttcacgtaaatccataagggttcattccaacattccttcaagtgctcctacatcgttttcagattgttcttccagtgattttcgtttcttccaggaattcctctttgagttattacaaacaaatctattaagaactctttcatcaattcctcaataattttctccaagcattcttcatgaagtacctccaacattacttctgcagttctttaaaacattttcagagtaatttcgcaagtaaaatctccatgggctctacaaatgctagtttaaggattcacaccagaaaatactacagtagtccttccggtaatttttctgctcatttcaatacaaattacttcgaaattcctgtccgatatttttcaataaattccttcagaaaactttgcaggatagtatccaataattccattgaagttttttcagaataataatataacggatctccagaagctctatcagatacctatcctagcatgagttcatcaggaatttctacagagttttcatcacagattaatttctctactgacagttccaccacaccataaaaaaatattcaaatcactataacttttttgtttgcgccatttttttacaagttctcctaaatctatccttttttcaaagttatttattaacgacactttaacctcgtcagggcattcgtgtcgggttagtcgtgtgttgatattgattcatctgattttaaagatattccgatattccttggggaaccgacacttcccatgtgaaatattttaggccgccattctgtttttagtcaacttacaaaaaaaatgaattgtgtgctatacaatataaggtaataatcagattctctgaacacgttgcacaaattggttgagttgtctccaagaaatcaaagaattataatatgatgttttctcaagttttcaagaactttttcggccggagttgtaacagaaacataaatgctcattactcaaaaatggttgcgccaatatgtttcgttatttcacaacagactctcatcaaagtattgtttcgaaaagcgaatagccaaacatgagaaaaaatctgtagcatgagatattcacgtgggtaataacaacttatcggtcatcaaggaatttgggaatatctccagatatagatagccattaaaaaaagccattgattaaaatagacacagattcttaaagtaaaagagttttttgtaaacttctgaaaaactagtgcaaaaatatcaaaaagccaaacaagctattgcggtttgaaaaatttgtggtgaaaaaaaatatggtggggttaataatgattttctgtggaaataccaaccatgactttttcatatacttttccaaaaaaaaacttgaaaaattcatttgataattctcttgagccatctctggaagatatcctggataaattcattgaaagtttccttgtgaaatttgtaaaagtaattccaggtctccttacagaaattcaggttggttataaccttaaaaattctcaataacaactttggaagaaatgctaagtactcccggcaggtattgcttgagaaattaatggttgaattcttgaagattttgtaaacagaaatcttggaggaaatactagggaagtcgatggaagaattactggataaattcccggagggtataggactttgagaggccttattaaggaatttttcaaacaaacttcggaagatttcctgacagaacttccagagaaatttttaggattatgcctaaaaaatccaaaatgttttgtgggaagtatcttgaacaaaagaatttctcactacataaacttttgaaaagtaatatttgaatgaaattttggaaaaatacctgaatttggctctgaagaatttcctgaagaaaattattaaaaatatagcaatatggacagttatgcgcgttattatgtcgcgtggagttccccaattttttttaaaaatatcttgaaagatgtctggtgggattatttgaggaattcttgtaagaactgttatctcttgatttctgtttggtttctttttattttcttggtttatgtttggtatttgttaggtatcattttggtttcctttgcttccttgtctggagaaatgaggttcctttttttcttcttgttgttctgaggaatatgtttgattcatcagtaggaaatattgaacactactgtgattcgatacaaatttctagcaaaactttgttatatctctgtaaattactgttgagctctattcggcattttgaaccatcttcccctcgctaacgctcgatgacgatggtgctggtgacggtggtgccgaggcgaacccttgaatttcctaaccccaaaaggatccgcacactggagctgacagtgcagcgcttagtgcaagaacgagaaggaaccactgggtccgctttctgccggttccaccattatgggcccataccgacttggatgacgccgactgtggcttggggtaggtaccgttgccaccgcgctgctctcgtccacatgcagcgagcctttccgcaccgcgccgtgacctagtttcgcttcgtagatcctttcgccacccattcttccatcacttcggcttcgcattcggtttcggttcggttctcggttcgcttggtggcggcaatctagagcagtcagtcgcgcgaggagccaatctagcacagagaggatagaagggcgggaccggggggacgacgacgggggcgattgcgccccaaatgtaccacgacgacgacgacgacggcgtcaaagcgcagcacacacagtcagagagcggcgaaaaaaaagctgtttggtttggggttctgtgtagagaaactgctgccggtgctcgatgatgatgatggctatgggtgattcttatttttttttctgttttcgctgaatgaaatgcagaagaaatgaagcccagaacacggattgcatcctttttgtgctttgtgtaacggatgcaacgttgtttttaatttttttttttgtgaaattgatatctggcgattttttcttggaattctgtttgggttcgttctcgtttaagctgttgaatactttatcagaatcataatttatgtagactgtcgattttattcagtgtagtatacacggaaacataattctactaaaaacttatatgtttcaacgcaatcccgtgcttgctcctaataaccccaactttggacaaatttccaaagttgacaatggattttattagaagaattcaatcaaatttgaattggtttattgcaaaattatgttttaacaaccagtgttgaaaccaggcattgcagaattcgtcttcaattgatttcgaagcatgatcaaaacaattgaagaaaaacatcgcatctgcatcggtccatgatcggcaatgtatcgcaagttgtaacaagtttgataaatagtagcagcgaaggagaagaataataaaacccagctttcttgcttctctaccattggaggtaggtgtttgactttactggaatgataaacaattcccgaacagcctacagcaatgatgaactatcatctgcccgatattatcagagctgtaacaatagacgatcaacagactctcatgatgtattgcggatcatgattacagagagtgataagtgagagatactctcaattttctcagaattcaacccctggttgtcacattcctgtctgcactagtttcagcctctggttcttcatcatgtataccagaaattctaaaaaactgtacccatcatactatttgaatatgaaacactttatattcgaaccttctgagcagaatctcaataatcaaaatgaatttattgaattaaactattctcataggatagatgcagctcttttcatttttgacaaatgttggggtattagaataatcgattcatctaattgcggttataataaactcaaaacttggatatttttgctccgtgtatgcattgtttatgaatgaagaaaagtttggaaaaattttgacttgatattattgataactatcaggaaagcgatctttaagtggatcacttcaatgtattgttgctaataatttgtgcctttctcgtgaatttaagtcccatagtccaatatgatttcccgaccgccatttaatcactaatttagccttttagcgatactttaacttaactaatactttattttcttctcttccaggtatgtcctacttttccttattctgtaacaacgtagtcttcaacaacatttatgtcgtatggtgagttattgaaaacgccaatgagttcattgctcaaactctatcattctatcagtgaacgatactatcaatccagaaatcgctgctaagtctagtattctttaaaatgttacacaaaatcaagtactagtccaatccgaaaattacggaagtacattatattaagccccaaggcaaagattttcgaataaaagagctgttttttttaattttctttgatatctcgatttcaaagcaaaaactgctgcaattttactggggcattgaattatcaattaaatactgaacaatttcatacattattaataacgctataagaaataaaatttggagatatctagtggacaaaaattattaaatcctgtcaggacctccagtgaaaaactctcaagatgttcatcgaaattatttcaggattttccataaaatctaaacatgactcgcaatgaaatcctttcagggttcaataaattctcctcctctattcaagtttctaattaaatcttctcagttgatttattctcagagtttccattgacatctctcagaatttccacttaaattctctcattgtactggtttgaattctttaggaagctgttgttgaaactctctaaagattgccgttgaagacctctatgaagatttccgccgaattcctttcacactttttgttagaatattttttatctctgttattctctgttgttcctgtaaatcctctcatcctccgttgtaatcatctcagaatatacattaacacatgtatggaagtaataaacagtattcaaattatctattcaggtaaaaacgtatgattagcaaactcagataaatttgatatggaaaccaaacaacaaatatattgtcagttattggttttatcttggcttgagtagattaactacaacatccttcctgaatttctgatggaatcctctacagatgtcttttgaaatcttctcagggtttgtgcttgaatcatctcaagattttagggatcgcagcaagcgttgataccaaatggttgtgtttttcgtgcgtctgtcaaatttttgcgcttggaatttaaatttttgattgtatttcaataatgatttatgaaattgaaaatatgatttaactgtagatttacgagctgtatgaactgttgggtgctaaaaggtatgactgtgaatcaaaacgttttttcttcagtgcctgttgagtgtattcctgcccacggtatacacaacaagatagggtattcccacgtgtaaacaagattttccatcaaaacatgtgtcatcattcctatcgtcaagcatgaggccttgaggatagtaaaggagagcaggcttttcttttgcactcgttcgagtttgcgataggaatgacgtcactgccaaatgtcatttttcggagtataataccttgcttcgttttaacatgttcctgctgttcatacatcagtaattatcgacgaatggttaagcggaaccattcgccaccacctatacaatctaattccagccatgtcatggacaaattctgtgagatattttctagaagatccgaatcttgctatctgaaaatgcaaattagccactgaacttatatagaaatataagttcagtggctaatttgcatttccagatagcaagcttcggatcttctagcttttccttacatcacaactctcgagcataaactgatacatacttttgtttcacatattgatgcttcttatagttcaatatcaattcaaacaataaaaaatacttcaatagtagagggcaaagttttaacttcgttccagagagcaagtaatggcgcttaagccaaggctttaaggccagcacatgcgggagaaatacctgtgtcccatcccaaccaaggagtgtgtaataactttcttagcaacgccactcccaacgatttaaacttttcctttacagttggtacggttgtcctcgtttcttctttcgttcaatttaaaactttacgtctatcacgttattcataagtgaataatctgatcgccgtgagcttttgaattatcttcaataccatgtcagtgggccttgccattttaatattcatatcatattaccgatatgctgcaaatattaatgctgacaagaaaataccaggtatttccaggatgcttttcaatattggctgtgcaagcgcttagatagatagatagaatcatcacaagattttcggtaaatttttatcagaattttcgacgaaatacgataagtattatcactgtacacgtcgtaaaattttcgttgacatcttctcgaaattttgaacaaacccatataagattttccatgatgtccgatgaaatcctccaaggattctcaatggactcctttcaggatttggatttgcactgaaatgcttcaaaattctgaatttacgatcctctcaggatttccgatagaatcttctcaggattttgggtaaaatcttctcaggatcccatctgatgaaatcttcttacgatttttaacaaaatcttagaattttcataaaaaaaattgggtattcaacgaaatacttcaagattttctacaaaatcctcccagattttcggggtttaaaacaaattttttttttatcgattaaaactaaaacaatcccagtgaaatccttctaggatttccagtgaaatcattttatgatttccagtgaaatacttctatgatttccagtaaaatcctcctaggatttccagtgaaatccttctaggatttccagtaaaatcattctatgatttccagtgaaatccttctagaattttctgtgaactccttctaggatttccagtgaaattcttctagggtttccagtcaaatccttctaggatttgcagtgaaatgcttgtaggatttccattgaaatccttgtagaatttccagtgaaatccttgtcgaatttccagttagaatccttctaggttttccagtgaaatccttctaggatttccagtgaaatccttctaggatttccagtgaaatccttctaggatttccagtgaaatccttctaggatttccagtgaaatccttctaagatttcctgtgaaatccttctaggatttccagtgaaatccttcttggatttccagtgaaatccttcttggatttccagtgaaatccttcttggatttccagtgaaatccttcttggatttccagtgaaatccttcttagatatccagtaaaatccttctaggatttccagtgaaatccttctaggatttccagtgaattccttctaggatttccagtgaaatccttctaggatttccagtgaaatccttctaggatttccagtgaaatccttctaggatttccagtgaaatccttctaagatttccagtgaaatccttctaggatttccattgaaatccttctaggatttccattgaaatccttcaaggctttccagtgaaatcctgctaggatttcctttgaaatcctgctaggatttccgttgaaatcctgctaggatttcccttgaaatcctgctaggatttccgttcaaatcctgctaggatttccgttgaaatcctgctacaatttccgttgaaattattctaggattttcaacgaaatcctcctaggatttccaacgaaattcttatagggtttccagcgaaatccttctaggatttccaagcaaatccttcagggattttcaagcgataccttctaggatttacaaagaaattccaactccttctaatttttcgattcaatgaaatcctttgaggacttccaacgaaatcatttctgagatccttgttaaattcttgttttgatatctgttcaaattgttacagattttccgttggaattatgttttattgttttgcacatattaaaacaacagttgcaacgaatttaaggactactacaggagcaaatattcacaatttttataattattttgaaaaaaaaaaaattccaatttcgagacctgctatattcttttgaagtgacgctgtttatctagttaatttattctaacacaggggttttcagcgtttttgactcccggagcagaaataaaatttgttgcgcggagtacctattattgatttgttataacatacatatgtttgattctcatttgatgtgtaatctaaaaattcgttcattttgtttttttctcgatcaacctatcacagaagtggttgggtgacaaaacgtcgaatctcaaaacgttgaatgccaaaacgtcgaaacggcaagacgtcgaagggacaaaacgtcgaaaggacaaaacgtcaaatagtaaaaaaaaaaaaatgaaggaaacgtaattccttggaagagagattctttcccgaaagaataaataattcggcatatgccaaacctcattcatagcatatttaatcgaccccgattaaaaataagaagtctggccaacaatgttgaaaattcgctgctttcgacgttttggcgttcgatgttctggctttcgacattttttcctaaacccacagaagtagcgcctggtggtaatcattttgctctttaactgtgtttcctttagttacttggaaaataatatatttttcataaaaatgtaaaaaaatggttgggtgacaaaacgttgaaaggacaaaacgtcgaagggacaaaacttcgaaaagaaagaaaaaacatggcagaaaaggaggattacttggacgaataattctcttctggaataatgaataattcacaatgtgccaaactttatggaatcgaccacatagtgaaaaaaaaatctggataacaattccaaatcggtgttggaaaatttatgctttcgacgttttgtccctttcgacgttttgggattcgacattttggcattcgacggtctgtcttttgacattttgtccctaaaccatttaaaagggtttgaggggaaaatgacgaaagataaaacgtcgaaagctaaaacgttgaatgtcaaaacgtcgaaagaacaaaacgtcgaattagttattctttcggaagagaatcatttttttaattaattatcgtttcttttcaattctttcctttcaacggtttgtcccttcgatgttttctcctttcgacgttatggctttcgacgttcatccatttaaatgtagtgtattttgtttccaaaactaggtaaccagaagaggcttcaagaaaaaataaacaagataaggatgttcaaaaataaaaatcagaaaaatcaaaaactaaaatttgcaaatttgcgaaaaaaaaaataaatctttgcttagatcggtttcgaaatttcgattattatcgtatttgtatgcacctcaatttttttaaagaggataagtatctcgaaaaactttcacatcctgaaagttctaaaattatctatcggggaaaactgaatttctttaactttggactgttttccatactaaattcaagaatgctgatcacactaaaaaatatccgaggtgcctgaaagtaagataatgaacgagatttttacaccgtgtgtagaaacctcgagcaaatgtgttttgcaatccaccataacttcggaaaacatcatgaagtgaagtgaagttgaattaaaatcactcttaaattttcaagagtacaattctatagaacaaaacaggggtcttaaacaaaaaataatcgatcgattcacgacaagtggattacaacaaagttgtaacaggttttatcactcggtttgcgcgtttttgtaacagaaatatgttattatttattttggctggttagtagctaaaataacaaaaattataacacaatttcttctaacaaaaatgaaacaaaatttgttatttgtaacaaatttcgatagaattgtgctatatttttgttgtaatccacttggtcgggttggtgcaaccaacgagtttcaaactgaataaattttcagcgcgatcggctattttgttctagttatcaaattttcaaaactgtcgcggagtactgccaaggatcacatgtttaaatctaaataccagaatcagattctttacgatttctcatcaaatgtcgatgcccgaacgttcttcgaaagtcagttcttcgaaaattcggatttaccgaataataaattcgctgaaaaatcattgctattcataactgtcataactctatgtgttttatggtagtatacgaactgggtatctgatatacatccttgtttctttgattggcgattcattcaaattataatatgaactttttttaactacaaatgtataaatgacaaatgttggacgatttcttgagatatatgtgttcttcgatggtaataatctcaaataaatgtcctaataatgccatcgataatcttaacctcaatttcacattcaatttggcttaataatgacccagatttctgtattcagatcgcctatcgttcgcacaaatacctcacacgttagccagcaccgaaaagatgtcacaccaaggacgggagcccggttgatgtcgcactcgatgaaagaatattttgccaaatgggacgccccaacctcagagtcatcctccgagagtgatttctgaagattcttcggcgtaccgaccggcaccgatgcgtcccataaatttttgccgcacattatgtgcaaaaaagtgcaatataggtgaagatggcttcgggtaaaaaatgcactttgcaaagtttatttttgcatacttgcttctaaacatatgtagattgaaggtatgtgcaggcatgcagtgtggctccaacaggatgagacgaagattgttgtcatcggtcgatgatgtgctctgggtgacgatatcataagatccagagtgcttttcagcatctcttctgatgaagaattttatggctaggaatagtctgtgtactcatatgaaatagaataaaattgattattttcaaccatttacagtctaaattattatatgaaagtgaggcacatctaaaatttaaccaaatgcattcaatccttcctacacagaagagacacccaacatcgaaaacttttaaacagtacgaattgcttgaaagaatttctcatactttaaaaacctaacagaaaactactatatcttgcaccattccgtctgtctatatgtatgtgtgcggttgtatgtgcacccggtcgccaaatgggcggcattcttgtgccgttgctatgcacactaaactaatgcaattctttccgccctagcttctgcgtaagttgctcctcgtaagttaccatcattgccaccttctagctctcccgctttctcaacaatgcagtcgagttctgtcgtcgtcgccgccgccgccaggatagtgcgtgaattcgcggaagaaaagttgaaatatttgcttccggagtttttcttcgaagggaaaagaaaccgacggggagactgggacaggatacttcagaataaactactgtcttggaaggaataaatttccattaacttacatatgaacgtggatgtaaatgtcctctcgggtatttcgttgttgatttttaatgagacgattatgtagactgaatgagagcctaagagtgtatttgcgttaaatggctaacatttgacttacagattggatcatttgacgtcctggagagttttattgaaaatttggaaggatatcattggaaaatttcagtgcaatcatctcaaaatttcaaatgaattcctcttaggattttctgtgaaattcttgcaagaattccagtagattccttgcaggattttcagtgaaatcctctgaggacttcctgtggaatcctcttaggattttctgtgaaatcctcttatgatttcctgtgaaatcctctcaggatttcctgagaagttctttcaggatttcctgtgaaatcctctcaggatttcgagcgaaatcctttcaggacttccagtgaaaccctctcaggatttccagtgagatcttcttagtatttccagtgaaaccctctcatggtttccagtaaattcctctcagtatttccagtgaattcttttcaagttttccaatgagttcctctcaggatttccagtaaaatcttctccggatttccagtgaaatcctcttaggattttcagtgaaatcctctcaagaattccagtgaaatccactcaggattttcagtgaaatcctctcaggaattccagttaaatcctctcaagatttccagtgaaatcagctcaggatatccaatgaaatcctctcaggttttgcattgaaatcttctcaggatttccagtgaaatccactcagaatttccagtgaaattctctcaggatttccagttaaatcatatctggatttccgctgaaatcctctcaagatttccagtgaaatcctctcaggatttccagtgaaatcctcccaggatttccagtgaaatcctcccaggatttccagtgaaatcctctcaagatttccagtgaaatcagatcaggatatccattgaaattctctcaggttttgcattgaaatcttctcaggatttccagtgaaatccactcagaatttccagtgaaattctctcaggatttccagttaaatcatatcaggatttccattgaaatcctctcaagatttccagtgaaatcctcttagtatttccagtgaaatcttctcaggatttccagtgaaatcctctcaggattttcagtaaaattctctcaggatttccagtgaaatcctctgaggatttccagcgaaatcctctcagtatttccagtgaaatcctcatgatttctagtgaaatcctacagtgaaatccttctcaagatttccagttaatcccatctcagcatttccaatgaaatacttctcagtatttccagtaaaatcctttcaggattcccagtgaaattctttatgcattatcaatgaagtaaaatgtaacaaagaagccctttacctatccaacaacttctacatctaacataactagtcagtgtaagcaaaaatcctcccgtcatctaaattcacactgcttccaatcggaaagctaatcgattcataaattactaccaaacaaaccatccccgaggagaacccttccacttttattttgcaacctactttcgctccactaagaagaagaaacccattcttttgaccgagctccctcttcttctcattataattttcaaaccctcttcgaagacacatcgagcaaaaaaaaaaaaacctttgcgaaaaacataagcatatgaggagcggaactatagaatcataaaatgtacggtactcgttgtaaaggaatcgctcacatacacatcgaaagggcggatcctcaatgccggtcttcaaacgccttttgctcccatcttccgtcggcaagagcgacggaacacgtggcagtcggtcggaaaagagtggggtagtcacattccttggcatatcccgaccagaattacatgacaagattgtaacacattgctatcaatcagtagttctcgttgaccattactaaacgacctatgtaacaattaaagattcttttctctttccctctcttttgattatagcagtgcaatactaaagcttttgggaagattttcacttggctagcatttcacacaaaaaatcgcaacagaagaggataatgtggctctcaatattggataggtccttttgaaaagttactcgtgagttagagataacaaaagttgataatatttactcatcgagatgaatgtcagtcaacatttaacggtgaaatagctatgcaaatctgttgactcgttctaaagccaactcgtgacatcaaacaccattccatttttagtaacatcgattttatgttttaatattaaaataatgtatcagaaaaacacattctgttataatcgtgcttcttccctcgggtcgggaccgacgcaagttgtctgcctgggttcccttttccgcgcagcagaagacacaacatccttattctgagaaacgagcggtctctctgtttctcataactagagcaggcacccaaattacccaaagtgtgtcactcacacactttcgggggtggagcagccctactaacacactaaccggtgtcattattcagcacgttagtgttcccattcggctgactgactggtctgaaaaggattatccccacggcaaaacaaaaactgcgagattgggagtaatccactcggtggctatgaatgggtaatttctggttatttcataatgacaaatttctgtaaaatatatactttcattagaatctttattgtgaagctgaagtgttcttcattatgtgtatgaccatatttaaacagacatacacggatgagctccactgagtcgcatcaatttgcaacacttcaacagtgatgccagatctacgggaatttaaataaaaccgtaaatttttaaataaaatcttgtttttatttaataatacgaaaaagcaagttcttgcaactagtttagcaatttttcccgctcaaataacggctaaatcacgtttgaacttcaagtccaaatatgacacttttgatcatgtttgacgttcacttagtcgaccaaaatgccacaggggttgtagttttaacactggggttgttcctatttgacatttcgggaggaacatggacaactaaaaacactcaaaatttgtctttaaaccaaggggtgtgacaaaatctcagaaaaatacggatgaagttgtgtattggtcttaaaccaacgaaaaacgtttaaaaattgagtaaacttgtgcttctggcctaaattttggtacaaaaattgggacagagctttaggactctattaatctacgttataccaacgatttttcgttctcagtacaagttttttttcttatgtgtattggttgcatgccgttcattttgcattgcggtaggaattgccaagatttttttgaggaatttcattaggtaatggcttatcaaccaacatctttgaaaattgttccagtgattcttacagagtcaaacaaaatcgctggaaggatttctccgtagaagttcttgattgaattcatgaaaacaaatatcaaaatcatacttgtatatcccttttgggaaattgttgagaaatttggagaaattccttaagaaatctctgaacaaattgataggacgattcttgcagaaatcttcatggagaatctctagaagaacttcgtgagaaatacgtggaggaatggattactctctttgctcatgactgaagttgatctacaggagtagatattcatgataagtggcacaagttttttttcttatgtgtattggttgcatgccgttcattttgcattgcggtaggaattgccaagatttttttgaggaatttcattaggtaatggcttatcaaccaacatctttgaaaattgttccagtgattcttacagagtcaaacaaaatcgctggaaggatttctccgtagaagttcttgattgaattcatgaaaacaaatatcaaaatcatacttgtatatcccttttgggaaattgttgagaaatttggagaaattccttaagaaatctctgaacaaattgataggacgattcttgcagaaatcttcatggagaatctctagaagaacttcgtgagaaatacgtggaggaatggattactctctttgctcatgactgaagttgatctacaggagtagatattcatgataagtggcccagaggaagccctaatgaaatgtatcagggattacgtgaaattgctgaaagtgcttcttaagcaggaatttcagaagaaaatcatgagggtactttctttaacacatcctcattgaatcctagagttattcatgaatatatccctacaggggccttccttagtcgagtggttagagtccacggctacaaagcaaagccatgctgaaggtgtctgggttcgattcctggtcggtccaggatcttttcgtaatggaaatttccttgacttccctgggcatagagtataatcgtacctgccacacgatatacgaatgcgaaaatggcaactttggcatagaaagctctcagttaataactgtggaggtgctcataagaacactaagctgagtagcaggctttgtcccagtgaggacgttaatgctaagaaaaagaagaaaaatccctgaaggaactcctgtaacaactgaaatgaagcttaatgagcaatcttttcgaaagtttatagaggaagtttaacaagaatttctagaaaaattcgttaagaaatgtctggaataatattgagaagaaattattaaatcaacttgtttgaaaaacattggcttatttctgatacaattcctggttgaatttaaaaatgaatcctggaaattttgtagttcttggctgtaatttgatgaatgctttcgactgtgatgactaacttctttctaaagttgaggtagctaaaacgacttttgcaattttatacggtcacaagtcggacaagataccaatacacacgacaacacgcagcctctgtaagtcacacaacaaaaaccacttttattttcgaaaatctgtatcaattttatatcttgtagaagcaaaagtcgttttagctgcctaaagactgatagagtcgataaaactttagaaagaagttcttggatataccttcgaagacaatactttgagaaatttcagcaaatattctcagcttgaatatctttccacatgtatgatgcatctcttgagaagcgcatcaaatatatcagaagaaattacaaagaaaaatgtgtgaattttagaagcctttctgggatgaatctatcgatagaaatgaattcacatccgttggaagaattatttgttgattttctgaagaaatttctgagaaattttcgtttgaatttcaggaaaaatataggaattcgatactcttttagatccaaatattgttagaatctcaaaacctataatgatcccgaatgcaacgcaaaaaggaatctcttgataaattccttttaagaatttcaataactagttccttgcggaattctgtatagcagttcatgaccaatagggtgcggcttatttttcaaaagctcacaaatccagaaatttgtgtgctcttctgaattcaaatcacataaatagagaaaattcaaaatttgagccaaaaaaaggtggcgcaagcgacttgaaggtgtattttcaagttatcagaaattaccttcagtgaagcatacataactttgttatctttcaatcaattttgaaatttaagcatcattcttcttaaaattaaatatatgaaaactttctagaacaccgaatttgtataaaatcaaaactagtttagttaaaagtagtttactccaaatttttccatatttactaaaaaattcatctttatttgaccataacttcatgaatactcatccgactacaaatctttctacatactttcgaatctaatctagttgttttcaaactgttcattgaacaaatttcactaattggtttgaccaagttatttaacaaaaactgctcaaaccatgattttttttaacaaaaattccatttgttcaagtttttgccagttacaaagcagaaactgttttttttccatttgttaaaccttaaaggactttgcaacaattttcaaataatttcgaaatcaaaatatttttaaatatgttaaaaaataaatgcactattcaactcgttattaaaacaagatgctttataaatttaatttttatagaaaaaataaaatgcaattttggtcggaaaaacttaaataaaccaaatttttttttcgttcaaaaatcatgttttgatgttttttaaaatttaattttgaagataatggtgctgaaagtttcaaaattggttagaaaataacgaagttatggtgacttcactaccgaaagttttttaaaacttgaaaattccccttcaggtcgcttgcgccacctttaaatgttaatatttttggttcaacttttgaagtttctctttttatgtgatttgaattcagaagagcacataaattaaaaaaaaataaaccacatctgttcagtttattatcgtgatctccagccgcctttttttaatcgacggcataaggattctctagtgttctccatccttgctttcttctgaaacctcagctattatgtgaatttctaagctggtttctgacatgtatcccccaaaatttcttccaggggaacttcgggtagtttctctaacctggttaattcacaaatttcgtcagggattccttcagaaattccacgctgaattcatatataaatttcgtcagcgattctcaacactttcatgaacatttttccaagactcccacaacaaatctttctaggattttttgtaggagattctctagaatacctaaaaagttcttagaaaaattcttgaaggaattgctttggaatatttatttaaatacttcaatagcttcttaaaagattttataaaccaatttgaagctactgcccccttcagaaggaatttctcccgaaggatttccaaagaatattcatacaattttttctagtaatttcttctgaaattcatatagacattcattttctcaaatatttgttcgagcattgctgccacaattctattaacaatttcttcaggcattgtttgaaagatttttgaagtgatttctctaagaattcctccagagatacttctgagtgaacttcctaaaatttatgaaaaaagtatctcaatgctttttcaagcagtccagagaaacagtcttttgggaaatcatttgaaaattactccatttgtttctcccgagatttctgcggaattgttccagggaatgttgaaagcatttccttagagagtcttgcagcttcccctctcaaatgtaaatatttatccagaaacttttacatggatactatccttttgttttgaggatacttcactgataaattaatgagaaaatctcttaagaaattcctggcgaaacctttggaaaatatctgtaatattgttccctgaattccctgctggacaagttttaggatttatttgtgaagaaatttctaaagaaattactcaaaaatccatagaaaatttcatcacaaaaaaaatagaaaggaaggaaattacacttcaataatatagacaaacatctaagtttgagttgaaaagttcttatatgaatttctcgaagcataatgaatttcttaacgtatgggaaacaaagaaattgcccaattatacttttgaggaggtaggtgcagtgcttttgggcacttccgtgattcactttggcatggggggtttttctcggccgaattgtctgaaactttgcaataaaaagcatattattacgacgaatattgtggccaagtatgagctcagtagcttttaaaaaaccccactgccgaagtgaatcaaaagttgcatgaataggatccggctccctagtttttgggataatctattttcttttattcacaaaatttgtggcaaaacattcccgatgaatcgttaaacaaattcatttagtaatccttgatggcaattctaataaaaatcttttacaaaagttatttagaaataagtgataaaagaatttatgagatatttttggcgaatgagcctcttcaatctcttcacgctataattttctcgattaaaacaaaacttttgtacatcgagcctaagaaagacgcttcttaagcacattgtttgaaaaatcgtcaattaatatttggatacaattccagatggttattgtaatggtcgctatctactcgccgtgtactcgagggaccgattcttcttccgacagatgatgccttccatcgtggaggttcggtgaatcaaggtatgggagcagtgatattttcgaatgacgtcacgcaacctctttacatctttgttgtcgaacagcgttttcaacgcttcctttttctttgtcattatcttcgccggacggccactaccggccttccgatccacgctcagggatgtcaggatccagtaaacgggcacgttttcgtctcaaaagtggtctaccgtaaactatttactacacgatgaccatgcgtttcgtaaaaccgtacaacacgctcgtggagtgcttgccgattcgacgccatcttcgattgaactgacagcgcccgagcgaaaagaaacatgccacccatttttagggagtgcagagagcaattctcttgtggagagaaaaaaaatacgcacttcacttcaattgcagataggtattgaaatcattatcattttactgaatactcattttttttctatctttattaacgagatttttagccctgggctagtttcatctcgggaccaatggctttacttcccttccaaattcactcattatttttgaataccctaaaactgaaatctgtagtaaattaaccatttaaaccagcatacaagatggtaatcgtgcctacaagttgactgaaatcgataaactatgaattatcaacagttaatttctcaaaaaccagacgagcgatgacatttttgaaaacggcaataaattcagggtcccaaaatcgagtgaatatcgacactttgtggctcgagacaaaaacttgttccgcactaatttttgttaatcaaacctaccgatattgcaagaaaaaacaacctggctgcacttcaacgctttcgtactcacaagaacgatgctttgtacacaatcctccgtccaagttgagttacctcctccccacatcatcccgtcctcttttgcagtgttctatccaagagcaagccgtttctgatgtttactacccatccatccatctcagcaagcgcctttcgttcggatgactgtgcgctgctgctgctgttgtgtttgagtgacccagatttggagctcgctctttctctgctgacgacagcacacgcacactgttccccatagaggatttccgttctttcttggccttcctcgattccccacttgcaagtccccgaaggaaggaactcaacaatgaagttcgattctcggttttctttcaaacaacctagcgtgaccggtatttgtgagtggctgaaaaggctcaatttagaacagcatacaaacgcaacaggtaccgttatagaacattccttctaatgcgattgggaaccctttcttttgggactttttattaggagccggtttagtcccctttttgtcgaagcaaaccacatcatgaatcgcttatgtcacgctttcgggactcaatcgaagaagtaagccgtcgtcgtcgtcgtcattcatatgcgaataaacaaagcattcagttcagcagatcaaacaacattcggtctggtctggtctcgtctcgtctgcggctgcggtattgcgattgcgaagtgcgcgggcgtgttcggctcggaaccgagccgagtgcgcgaatttcactttcgttttcattcgtcgcactgcgcgcaaatcgcgtcatcgcttctcgtcgctttattcattgtattgttttgctgcgtttcggcccgcgtcgctcgtttgcacgaatgaatgagcgagtcagtgagagtgagtgagtgagacgcgagggctatttgcgaattcaaacaaaaatttgaaataatgtcgcacacttgtgtctgcttacagattatggccagatggaattgcattgtaggtttatggaagcaggtcgatggggcaaaacggtgcgaaaagtgtgtgacgggtaatttgcgatacattttgggttttgtttgtattacctacttggtgctcattgctggcttcgtttacggccagaagcatttgacggcggatattgggttgggacaggagagagaaaatgaatgacggtttttaaaattgaccaaagaggccattttatgacaaaaatgtatattttttctagttattcgtttaaagttttcaaagaaagcgaatataaatttcaaaattcattcaaattttgagaactgagtttgatgtttatgattttattgattgaaaccaaaaactgcaaatgacagggttcttggctttagtttttagttgtatctaaaagtaaaactttggaaaacgggcaaaatcactaaaacaagaagtttacgcagaaatttatctatcctcttcatctttctgacgtttactgacagtttttgatactatgagatgttttggacaccctggcaaacatgaatatttctttcccaatttttactgacatttcaaaagacatttataactttcctgtaaaattcttgatgattttctaacaagattgttcgaagaacctttcaaataatctttaacagacgtgggagtgggttttccactctaaatacgaataaaaagaatttagagtaggtttgatctagctgtgacattcgagaaagttacgtttgaagtatttgaatatctgtcagttgtggtacggcgattctggaagttaaaaatggccaatccttgattcagccagttttagacattcataagcatgtgagtcttttggatatgaaaattttataagaaaatgcctgcgaaattgctgcatcaaattcggaatgccctaaaagtattttacagccgactctccacatctcaatgttctacacttaaatggttggtgagtcctcagtaatagtccgagatgagaaagtttcacctcaaatgaaacctgttttacatagataatccataaggaagagttaagatttatcctaaattataggctaccgatgcaattaggtcaaacaaatcgtttggccccgctaacaaaagaattgatacaaattcaaatttttatacatggatcgattggatatactattaagctttcgttaaggtaaaacattcacatatcgggctatttttgcgaacgtaccaaccgttgttgggcaggtctgttctatcaataccaatatatcagaggttactagacctgatttccttgattcaaaacaaattgagaggcgcgaaagggcgtctgcttgtttattatttttcctgttttcttgacaacggagcggttttcaatctagtattcatcgaaaataagtatgttctttgtgtggatctctccctttcttgatggtccctttgatatccagatcaaggtttctagaagaggctagttcaatgtgtcagatttccctttccgccattttgaaatactgaatgacagctggcaattttttttttattataaactaacactacctacttcccattttttcttggcacaaagttcgtttgtcaaacactttcgacttttctatttgtttaatttcactaaatgctttcttgtgatccataatcaggtgcaaggcatcacaaagtatgtatggaatgtttcttttactagcacggggtacacattacagggaacttctgaccatcttcacaagtttgtggtaacaccaagcagttctgaacagtgaagatagaaatagaaaccgtagagtgaaaacagtgtagactaacccgccagctgtcacttctaccttccccatagagtacttcaccccgcactcactgactgctaaggttgatgtacctccctcaaagatatcttgatccagatgtggagagttgactgtagtaaacacaggcagaaggaaaatttagtcaagacgagattaaaccactttgaggaaggccattttgcttcgaagaaaacatcttaagaaagtctttgtgagatcttgaggaatttcttaggacataagttctaggcagtttacaattgacattcgattcaatctagagatccaggctaatccacggcgtatttctcacgagattcttcatggattccataagacaaccctagtagatatccgacaatccggaatctcttactgactctcgatatcactcctacaggaggttatctgacaaaattcatgatggattcaggaggacagtagactagtggatatttttccagcatccactgcagtgaaattctagtggaggattgactagttccaggtgcgattttcgagttttctctagactgatttctggtataaaaaattgagattcatatgtcaagtaatggtctctgtcgaaaattcttgcctgattagtgcagagatttttgataaattccagatccattcgttgacgtaggttgataagacactttatggtttactgacatgatttttgtttctgattcatgtcgaattccttcttgatagagaaacttaaaagtagatggagtaccgtgtaccttttaattccgctcctaaatgcttatctttgacagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctatttgagattctgctcagaggattcgaacattcattaaagagtccttcttgataggttgcttgagaaacctttgtcaaattttttgtctcattcagatagcaagtctagtgaggttcttgctgtatttctgaaaacccttgataaattattgctgggatcttagggagattctagacgcattcatttaagtatcattgataacattcctgacatggttgttcttcgactcatgacaagagccttgcttgatttttgattccggatgatcttgaattgctaacgacacttttgacagattcttgctgtaagtcttgttggatttctggtacacttttgacagatactttgaaagatcgttggtagatttcttactaaagatctttatagatttcaagagaaacctttgacaaattagagtcgacattctggctgtatgtcttgtaaactcattggattacttttcccagttaatatatgatagcagatcttgattgatgcgggggttgaaagctaattcgaagtatttgataaaatttgatgagtttgtatgaatcagttcttgatgttctcatatagtaagaattgataatcctgtgaaaaaattgaaatgaaataaattttggaactattatctttttttctctaatatgtgtgctcagtagtgtataacattacggagccatctcgaaaattaagttgacgattgtgttcaacgcaaacctatatctattctgttctagagtcgacccatcaatccattgcgatgcaaaatctattagtcaaacatgtaaatcttccacagaacacattacgaacgtagcatccgatgttttagttggttaattgttaccatgaccggtttttccccgcatgctttgcgtatagtcattcatgctattgttgatggccgagcataaaaatcggagaggaggtcacccaaaaataccgtccaacaaagtaggctgcgctcttcattcaaatgagttgcagcgaagggtggcgtcgcgcaacaatgaatattcaagtggataggtcgtcgtcgtcgtcggtggaaacaaatcgggtctgggtccccccagttttccctaaaagtttaatcaaaatttcagttggtaatagataaaataaagccatcacaaaaaacggtgtcactgtgtgaatgtcacagccggtgccgattggattacgacacgattcgcaatgttgtcacttttgtctagtgcgatgggttagggccatcattagctgtgtcactttgttgtcgttggcggcggcggtgccaaccgccgaagagaatgcgttgcgacaattttagaattttcaagggtaacagcactgacctagatttttgtttaatttacgtaatggtgtagctacatttcgaaatgctcgttggaaagtgagatttgtgcataattagtgggttagatttatgggatgaaagcaccgattttcggctttgaactccgatttctgacttgaacgactccaaatcagttgaacggagtataatccaattgcagtccacactgttttctgtgctcaaccagatagaattaccaccatgggatctcgctggtagtcgtcaaagcctgtagagaacaagcttctacaaaagcttcaataatgtggggcgttatagtcttaacggcatcgtccaagtcacatggagtatcgatggacggagaatatccatgagattaagtatctacctatctatctaccgttctatctatccatcttctatcttctatcttctatcttatatctccaatcttctatcttctatcttctatcttctatcttctatcttctatcttctatcttctatcttctatcttctatcttctatcttctatcttctatcttctatcttctatcttctatcttctatcttctatcttctatcttctatcttctaacttctatcttctatcttctatcttctatcacctatcttctatctatctattctgtatagcagggctagtagtaggtctctttttagaaacttggtctttattttaatgcaagtttgtaaaaaataactttattttcaatgaaaagtttctaaaatttttgttttcatccaaaatatgccttagagtcactgtttttcttctctttctcatataaattctgattcgaaatacctaatcaagaatttccacaggaagtaggtctcggaaattttacaaaatactattccagaaggtgactaccggtgaacaatttttccgaagagaagtaattctcttccataactcaccagcaagaaacatttcttttcttcgaagaaaatatgcgccggaattcgcctacagaacttccaaagattcctgtttccaagagaatccaagagaacctcttcaagaattactcaagaagttcctacgttcagttgcattttcagttttttcatacgtatcttatattctctcaggaaattcttcaaaaaaaatttcaagttcattcagcaatttatctagaagtttctcctacattttatctacaaattactcttgcagttcttcctaacaactctcatgttctttttcatacgaaatctttacttcagtattacttttcgattttttaagggatttcattaataatttcttaaaaaatatcattgttggttccctaaaataacttctgaaaaaaaaatctatgaatttaaaagcaatcgtgcaggattttctgaagaaatcataggaagaatctcttgagtaatttctgattttattgcaagtctctgaacagtctttagttttatttattaagtatcttttacaggaaagtttacccaaaacctaccctattaattttatttcgagatagctaaccaggtattttcacttggaaatttcccaaaacagaattttagaatttcctccagtgatgttttcaccgattccgtttttctagcatatctttcaacgatgtctataggagttcttcctaaaacattttcaaaggtttattccggagattttgaagaaattcgaaatggttttccaggaacctctacaagaataactcaagaagttcctacgccaattttttcagttatatcttaagtaattatcatacaaatctcatattatctcaggaatgattttgcagcaactcctacacgaattattcaagaaacttctgcgccgagttattcagctaatatcttcagccattttcataggaatctcatattatctcagaaagtactccgaaattcttccagatattattgggttctattgagaactgttcttagaattctccaataatatccaaaaacaattcataattaaattcatccagtattttttttctagatgcgtggaatctttcatctacaaattattcttgcagtgcttccaaacaattctcaagtgtttcttcgagtaaaatatttgtttgaacaatacattcaaatttcagactaaaattattagttgtatcgcctgttttgattcccatataaacattagaccagcttacaatctaaatcccccaagtccaccttccgatcgttctcgccatcaatcgtcattgagaggtgtgtttgtgagaaacgctgttggagcctcgcgattcactctcagtttcctcgcgcttcagcccagcgcaacggcgatgaagtaatccaaagaatgtcaagcactcacggaaaatgaaaaggggtgtgctgtgcatcgcagagcagtcagtccactgagagtgagcgaccaccatcacggtggcaccatgggaatttgtaatgtttgagtggcggcctccttcgagccgaaccgaactgcgacttcaagcgtggttcagtgctatgcatgtgattaatcgcgtgtatacaagttctctttacctacctacatgaacggatggtcggcgcgcggcgcgcaagtaggtcatgacaacaagagacagcacacggtcagcgtgcggaaggaacaaaacgagacggccgatcagagccgtcaggactccgacggcgaacctcgctcgtgcaccctaaaaccgagccattcgggtgcgtgagtaactcaggttctctattgtttacaatggacaaattaggactgaatgtaatttgctacaaatggtgtactttgtcgtacctttggatccgattcatgcacgcgaaacaatggaatccgagtgcgtcgccaattgatgtgtagttaggttttagcgtgtgcgatacccgcgcgtgatgacgacgatgttggtatgtggtaacgatgacgacgaagcgtgaggcggcggtgatgcattgagaagcgggtgggtggttgctttgccattggtattcatggacgcaacaagagtgcaatgagagcttgctcggcgtttatggctaggaagagtgtgcagagggggtttctaatcgttttcggatgaggctctttaaaaaaacgcgaggaacagtttaagcgaagtggtaaaaaaataatagaaataaacggcttagaatgagtgtttgagtggcgatagttaaaattggaatttctttatgaagtttactcgttatcacctaattgttgtggtttaactattctaaaccaaaaactgattttgactacaaatatgtcctttatcagtctttttttatgtttcaacaagagaaaaaaaaactactgcttatctactcacgttaatgaggacgattttgcttgtccagaagtacaattcctagttcatccaactctccattacttgatattgaagaactcgagttagggaggtatcgaattacagaacacgaaatcagtgcaactgaggtcctaggttagccgtggaaaccaactttcactatggttctctaactcgatatcgagataccaaatttcgagtaagggaaagttgactataataacaaatatataaggggtttgaaatgctatctcgtggaaaattataaaaaagtaaattaaatattgtcactcaaactattctatcccacaaatcttagattcccctgtaaatggcacaaattagttcgactcagtttttcaacgaagtttcagatttgcttgccaaatcagtatttttattggaaaagctaatgcagaatcatattattccactccgataattttacctgacgcattctttagcatgaaaatgcgaaaaaatgctattttttgaatgcacactaataattctaaacaggtattttttttctaaaactaaaaacaaattgacaatcaaatgaaaaagcagatgtgtacatgaatgttttgaaattttcaagttagtagagagtttttaaatctgttttcgactacaacctgctaagggtcactttgattgtttttcttttgtaacttttgtaaaaaaacgtaatttagttataaacaaacagaactcgacgttattttatgtttcccgcctcgttgacagttatgtggaatattacggaaaaaacttagtatagtatcaaagcttatgtatggcgacaaagagcaaatttctgttttatggagctattgcatatgagttaaattgaaacttttccataacattgtaaaaaaaactgcttcattctataatgtgcaataagtacattgggtcattattaaattcctcatgcaataatggcaaaccaaatctaatacatgtttttctttatctctttacaggtatgtccaaaaccgatgagtaatcatttgattttgtaagtagcacttatacaaaaatagaagagttttcctctataaacaacgctgccataaaacctcatgctcttcggatatgactcgttttcgtaaattgttatctccatctcccttgggccctctgttctctctattggttatgcattcatattcctttcatcagtttcaataaaactagctaaaattccttgaaaacatagaattcttctttggactggaagctaagatagggcaaatgtaccattagtggtgcccccaaaataacagttataatgtgctgataaaatcatgaaatctatgattttacgggcagtaaatccttctatcattcaagtgtatcaaaattacggttcatttgaaatttctctgttaaaatctttgtcccaataataggaacactgttcctttggtagaggtatgtttttaacgatacaatccattggtttcttatgggaccctccactatgggtactaatttgccactttaagtgctaagaagcaaagtttttaagcttaataattgcttcaacattaaatttgatggaatcattcggttgtttgtatcattttcacatagaagatcgtagaaaaatatcacatagtcaattatttgtgcggaacacgtgaaaacacactacgtcaactattgtaactaccttcactaatggagcgtttaccctagtatttaaaaatttatttgaaactagtgggcccggcaagcttcgtcttgccatcaagtaggctgttcaaaaacgctatggatcgtcccatacaaaatgacagttccgttcacgttcgtttttccgactttcccggtgaatatcctgggatttttatacacacaaacacgtcggaacacttgacgaacaaaacggaaaaataatcattcatatcagttgacccgttcggaagccatttcgtgacatacgaacaccactccttttttatttatatagatagattctatcaaaagatttctttaaattgaaggttaaacatttagcgaagatttttaaattttatggaagtggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgcacacatgtgatgaatgtgacgcttctttattttgaacaataaatttcggtatatccaataatcaaagttcaaatcaaaatatcgtttccatagttttgatcttcttttgaagaaagtagttacttcagtctgcaatataggctttaaaacatatatttttatgtacttaataaattaatcaattattttcttaataatcgattaaattagtcgaatgtggaagcgaatgagaactttttcatttatttttcaaaggaagtaaatccgctttttaaatcagaacaacaatagaacatttctcctattaaaggtcaaatggagatattttaaaatatagacctttcaatcgagggttccgggtcatttggccgaatgccgtttggccgaacgccgtttggccgaaataggaaataatagtgaattacagtaaacatgttattgtagtgagtttcgcagctgaatttcaaagaacttattcaacttatttttaaagaaggtaaattatcattgatatacacataactggctctttaatgttagttcaacaaacagtcagttctaaaagaagaacatcctaaatttaagcaaatattcacttttctgctagcggtaatagctgccagcagaagtttttgcattgtgtttgtagtcagcttttgacagtaattaaatcggttcacgacttattagtcctgctgcaggactggattgcttcgatccctcgaatttcggcttcttattttcccagcggagaaattgtgaactttttccacgtaattgtttaccgagtcaatgggtttactgctatacgcaagcaacgatgcagagctctgttcacacgttgcaatcctaatattggaggataaacagaaagaacagcctatgatcaaaagaaggaaaaatctcttatgaaagtttaagcaactgcaatgcaatcaatttttatattagtataactacaaagaactgcagatgatttatagaaggtcaaattcccaattagaatataagctgaattattgccaatagtaatgaaaccagtataactcgaaaaaatagcctatgcttaaaagaaggaaaaacttctaatgaaatcattaaaaaactagaaccttatcataccgttagtagccccagatgaaacaaccatgagctttgattcttgatgcaatgagtggagttcacaacttagtcctaaattaacgggtcattttatcattctcttggagcacttatatagtgacaaacgtgacgtaccgtcacatcattaaagtcaattaattagcggattttttttttttttaaatctctatttgagtgtattttaacgcacgagggctagttctacacttttaattagcggatgaattattgagtaacacctaagaatcttacacataagtgttgtagtaatttgaaaaatttttttttgttcgtaattcggccaaacggcattcggccaaacgacccgttcggccaaatggcattcggccaaatggccggacacccaatcgagctacctgaaccagaggtatatttcgaaggaagaagcaacacatttagttcgatttggaatctagttaatgaagaacttgaaacaactgttagaaacaattctagaacttaccaggaaatttaaatttaagtcattattagaatgtttgagtccggaaattgaattgacaaatattttgaatgcatgtaaaaaacaaagtcgcatagttgttccaaacaacgtgttggtatattcctacactgccttatgatatcccttgccacaacattgccaggaacattcccttgccttccacgaatagtttagaaatttcaatttcaaataatttattagcgaatgaggcaactcgaattatcactgggaatcgatcgtaactatatacacgtgaggcctgggtttcgtgtgtttttcaatgtgacctttcgataacatatattgcttatgaagaattgtcgagagctgcgaaaatgttctaagaaaatgtttccaaatgtttgcatagcaacacaatctctggggcttttagaaagatgttgatgcacaatttcaaagaattcggtgagtgttcaatttattcaaaactgaagatctagtcattttgatagagacaccaatgtaattttgaacacaaaaacttttctaagttctataaaattgatccaagaaatattctgaatattttattagttgttattttgtcatgtcgcttaacaacctagcaaggctgttcaagtctgggtcttcagtcaaaattaatcgagattctgcatttcaattaaggtgtgtatttctaatattcgtacctacactcttaaaaataatgaaaattactctggacgtaattctggttaggactgaatgacacatgatgtaagtgatggaacgacacaaaaacgtgtccttcaagatgtattgaacaaaaaatgtaattttacatgttaaaggacacgaaaacgatggaactgtgatcgacatttcccgaatcagacactaacgtattttaaaatggacacaaatttacgtcattcggctcgcttcttttatgtgcatcccaaaagacgtaaatcacattattttttggtactgtgtattattacgtattataaaaaaaagaaaaagattgaaaaattggattgttaagcgattgatgccatattgatgagcacacttttctaagtaaaacacatgttattgctattcaatatattaattttaattttataaataactagtggtcccggcaaacttcgtcttaccatcaagtaggctgttgaaaaaacgttttagaacccatacaaaatgacagttccgttcactctcgtttttcggactatcccggtgattatcttgggattttcatacacacaaacacatcggaacacttgacgaacaaaacggagaaaaaatcatccaaatccgttgacccgtttgtaagccatttcgtgacctacaaacaccattccatttttatttatatagattaatgaagatttcaatctatagactcaatggtttttcaatttacaattgacagctcgcctcgtagaaaaatttgccgagaggtgattcaaacgcgatttccataataacttcaaaagttttttttaatagttcaagggcaagaaaaattgggaaactctgagttctggcttaattttaacttaggactagaatatgtaaaaagaataggtaccactaaacaagccaatggttcgaggaaattcgaaggaagtttaagaagtattttcaatgaaaacaaaaagtatggaaatctctttaatttcaaggaacattccctatattgttttctaccaatctttggtatatagttgaacttttctccgaaaaaaaaattacatttggattcaaatgtttctactatctcatagatatttcgaaggcaatctcaaaaatactcaaaggcgatcattacaatgaaattttcgtatggttatggaatttttttatggaagttttataggcaatttaaaaacaattacatatgatagctaaccgagattctaaaagaaatcaccaggtcatttcaatgaaaacgtgaacgaaattttgaaggaaatatcaacaagattttcaaagagaacttcaaaagattaagaattttagattgattggccgcccgtgactgctactctagtatcgacagatcaactgcacttacacaagaaaccaaccagatgactgcttgggactaactgacatcctcagtttataaatgctggtgatcttctatttttaggcaacaaaggcgcctgcaacgtcagaatgcagaccaacgaggaaaagggggaagacttgatgttgcatttaaatctggtccacatcaaaccggatatacccctgcatctacgccagttcatgctggaaggtagggatgaggttatttaatggcagaaagacttgctttatggttagcagactgctaagtataagtgtgataggttaaggctaagtagcccgtcattcgttttggcagcgatgatgacttgcaagcttgcaatttgaaagtgataaaattcagttttgaaagtttgtattgactttaaaaagtatcactgtacgcgctaacatgcgtaaagtatgctgatagtttttcagctgtgtcagtgcaaaacctactgattttctttgatttaaaaccgtgagatgaattagcatcaatcatcaacgacgcgtacaaatttcaatgacggcctacttcgccgtaagagtggacggtagaagcaagagacatacaactacaaagtacgagtaaacggtttggcctgggattgaaccattgaccttctgcttatgaagcagaaatggtagtcattagactaccaaccccgttctgaaagagaactccaagtgattatgatggaaatattttaaagaaaatttcaaagagacttcaaaggaaaatttctacatctttcctaaaattatctcaaatagaggccgatagcatagcatagcattaacaactgtacaaatcgtgggtggctgtacaatgctcaactcttttggctttaagaaatctatatgtagtgtcgcaaaaaaaaaaacgtttgggatgaacgtctttttctacataataggaatacacaaaacaagcatcacattgtacacctggccacgtcctcacaatcgctaggggaagaaaaggaatgttgttcaacgtctacttaaaaagatacagggaatccaaactatcttcatagacgtcacgggatatggagattgtgttagtagggtagggtgtattatataaggatcagctcaattcgacaatttagagcatttttggcaatggaaataataatatgtattgattttggatttacctgatcacttctgaaagagaacttgttattagtacaatacaaatcaaacactaaaatcagtgatgctcgtctcttcaagactaagcttgcccaaacaaagacgcgtaacatgatttgtcctgcttcttctgcccatccccacaggggcaagtgacactaacaaagcatcattcgctactcaattgtcttaatattatcagcattttttaatagaagaacacgtagttttatgtatctcaacatgttttctccgtaagaatatgtcaataaaaatttcatgcgggttttaatttaagccggtgttaatttaaagagcagcattcaaattgcttcagtacaggatgaacttgactctttcaaacagttgcccattttagttgccaagcttaaaaccaaaccagttatttcattctatactgcacttctagtctttaaatatgcacctaccaagagtttgaacaataaaaactagttctaccccttgaaaattggcaaagccgattctttccgagaaccagaacatccaccagcatgttcttacatcattacaaaatctaccatcgtcgtcagtaacgatccctccggtgtgtgcattaaatcgcgaacaacgctttagaacgcaaagaccccactttttcgcgaatacctacactcacacaagaaccaaaagcaacctaccaacaacttcgacgaaactgaaaacggaaaaacggcaaacaacaactaaaccccatctcccgtaatgcatggattgatgcactactggcggcctccgagagctaccgtgtcgtgagtttgccattgagagtggtgcgctaccaggttctacagtgttggacaatgcatttgaaactgtttccacatttttcatacaaattgatcacatgaatttttgttgatgtagaccatcattctgttcaaaatgaccttttcaagcagtttactgatggagccgtagctagaagaagctactgatggagacgatagctagaagcttctgcagaatttttgtccagcttcaaaattgttacaactttgccttgatgaggatgtaaaaaaatccatcatcgccagggtcgttaatatttttgaattcttgttcacaaaaaaaatggtttttatattgagaaaaatgttttcaatttcattttgcagatcatgccttttagttaccacagtaggatcgcgaatgcgttgaaattgccttctcctcacatttttaagacggatcaagagtttaagatcatcgtctataagcacggattcgaatttgacttcacattttggtattgcaatgtctcttgcttcaacaatggaatttatttaagtttcgagggcattgtcaatatcaagttttgtttgcaaagaaatgttaacatcaagactactatcgatatatgtttcatatgtattccactcggctagaaaataattggaagtggagccgataggattgagaatcgcttcattggatatttgaaatacaacagggacatgatcataatcaaaatcagcatgagtgaccagttgaccacaaaggtaactagagtcagttaaccctctaatacccaaatttttattttcgatttaagtattcttattcgttatctaaaatcgttctaaacacgttttgggcatttatttatttttattcgcaaatttttaaattttggtttttgatttttataatttttatttttgaacatccctagcttttttcattttttcttgaagccttttctagttgttgatttttggcaataataaaaattttaattgttacggtattttgaaaaatattaaattttttattttttttcggagcgtattttattttccgtgtaactaacggaaaaacaggtttgaaatgattttaatgtgataggttaatcgtagaaaaatataaaaggtacgattttttatattacacgttaaatgaagcccaggcatttgtaggttatataagaatgcaatttttcaaacaatttctaaaaatacaaaaaagtttcaaaagtcataaaaaacttttcttatatgcgtgttatgagtcaaggtatatgccaaaaataaaatcattttgatttcggagctacgaaaaaatacacaaaattccaaagtgtaccccgtctaaaggtggggttgggtattagagggttaagaccaagtcaatcgtagaagggttactagaaacggaaaaacaaataggactagcagggtattgaattgagattgagaatcctgaagaactctcatgaaataaatttctgccattttgcattaaggtcaccgatgacaatttttttttttgacctattgcgagtcaatttccgcaaatcagtttgaagcgaatgaactttctgcccagtgcattgaaaaggcaaatgggcagctatgaaagtatatttaccaagctgtgtttcaacagaatcacccaaagtgtcaaaaattttggtttcaaatggcaaaaaaaagttgttttttacgcctaagaactcccccacatgccccatcaagtggatcattacgattaacaaaaagtttggaccttttttgagtttggatccaggtttcaaatgagttttagtaatgagaatcaataagaattttttgccttacgccacatatgaattgagataaaaaaaattgctcaggtataacaccttaaagctgacaactctgtatgcaaaatcaaaaaaagttgcaaacccattgtccaacactgtctatgggtatgcgcttctgtgcccctttaatgttctagcatttggtgtacttatacctagcctagccgaagtctgactgactgtgctgaaaagccgcgaaagaatcggtaattgcacaagttttgcaaaccagttttctcaccacccttgccatcgtcgtcatcgtcattctggtggttggggtttcgcatcttctgtcctgcttccgctgcttatgctcgctccgtgatccgctcggaaatgcataaagcggggtttatgtttgccaatatatctatctatgtgggatatggcaacaatatgaattcctcgagcctaattcggggtggcttgtttcgaaaatatttcggttctgtggttaatcaacagctaaacatgcttaggtgatttcattaaaattccattaggttggtatgcaaaacggtattattgggtctataaattttcctgtaatctgcctataacttgtcgaagctagtctagttacaaacatgtctcgaaatgcacctgatcacttatcatacgtcttatgtggtcgatacaaaaattattgttgctatgcagataacacaccttatccttatatccttcgaaatctcattgtgatttcttttgaaatctcgttgagatttccatcgaaatctcgttgaaatgtccttcgaaacctcgttgagatttctttcgaaacctcgttgagatttccttcgaaatctcgtcaatatttccttctaaatttcgttaaaatttttttcgaattctcgttgagattttctacgttgagatatccttcgaaatctcgttgagatttctttcgaaatcgcgttgaaatttcctacaaaatctcgttgagatttccttcgaaatctcgttgaaatttccttcgaaatctcgttgagattaccttccaaatctcattgagattttcttcaaaatctcgttgagatttccatcgaaatttcgttgagatttccttcgaaatctcgttgagatttccttcgaaatctcgttgagatttccttcgaagtctcgttgagatttccttcgaaatctccttgaggcttccatcgaaatctcgttgagattttcttcgaactctcttcgaacttccttcgaaatctcgttgagattttcttcgaaatctcgttgagattttcttcgaaatctcgttgaagttaccttagaaatcttttcgagatttccttcgaaatctcgttgagatttcctttgaattctcgttgagatttacttcgaaatctcgcccgtgtaagtccttcgaaatgtcgttgagatttcctttgaaaattcgttgagatttcctttgaaatttcgttaagatttccttcgaaatcttgttgagatttctttcgaaatctcattgagatttccttcgaaatctcgtttggatttccttcgaaatcacgctgaaatttccttcgaaatctcgttaagatttccttcaaaatttcgtaacgatttccttcgaaatctcattgagatttccttcgaaatctcattgagatttccttcgaaatctcgttgagatttccttcgaaatctcgttgagatttccttcgaaatctcgttgagatttccttcgaaatctcgttgagatttccttcgaaatctcgttgagatttccttcgaaatctcgttgagatttccttcgaaatctcgttgagatttccttcgaaatctcgttgagattttcttcgaaatctcgttgagatttccttcgaaatctcgttgagatttccttcgaaatctcgttgagatttccttcgaaatatcgttgagatttccttcaaaatctcgttgagatttccttcaaaatctcgttgagatgtcctcctacatctcgttgagaattcctttaaaatattattaggattttctttaaaatctccttaagaattcttacgaaatctagtagaataaaatttctcgctaaatttttcactgtgtactgactgcaacttgtaagatgtattacattctaccacccagccaacccctctcagctgcatttcagcggcttcccaacatctcaaccagttccatggaagtaaaccgtgttctttctcgacggtgctaccaaagtggaagcacagtttagtgccaaaccgatgaagcagtagcaaactcggtgcgaaactaattcaatcgattggccaatcttccgctgctgccgactcgactgcctgatcgactctctaactagctcaccaccaacaaccggtcgaaatggttgaacatggtttttttcgagctccggtttgcacagttagtctacttgtttggcggttctagccgccgtaaattgcgtcgcgatggaaaaacggaatttgctcaaagtttccttttccaattctaggcacaagaacgctattactgcagggggccgggccacagtggtccgatgctgggctaaagttaaaaaaacttaggtttgcaaatttttctactgatatgttttgatggctatcttcagtatttaagtaatagcaattcccttaaagttttagggtaaaagcaccggttttggccagcctaagagaaaatgtcaataaaaactgaaagggaagccgtatttatacaacaaatatgtcaaatgcaagctttcaatccatattatatgtgtaaaatatcaaaactgagcctaaaccatttcttcgctttgaaaatcccgttggtcaatataggccaacggaaccagtttcggccagagatttaacttcggttccttaattgaccaattgcatcgatttctcatgagagtggtcaaattaggagtgccatggccaaattaggtgtatgggagttaaaattataaggaaaataattgtttttcttatgttttgaatcaatttggacaagtaaatgactgtagctctatcatatgaatgtgatctactgcacacaaaaggtttcatgctgattggctatgtaaaacggtgtataatccactatggctacaactggcgtatggccaaaaccggtgcttctaccctagatgaattgttgtatgtttagatttttaaataatgtgaatcgtacacggagacggaattcaactcaattttgggttgtttcaacgcaattccgtagttgagcccaataactcaattttggctaaatttccaaggtccccactaggtagtttggctttaattccattagaaaaatttactcaattttgggttgatttaacataaaattgagttctttcgacccaaacataagaaaagttgcatatacccaaatttggcttattgggccaaagtacccccattgggtagatgcagctctctctatttttgacaacattcgtgtgggagaaagagaaaaccgagagattttgggttgaaactataaacgatatacttaattttgggtaaagtaaactcaaaaattaggtaaaaatatttctccgtgtagagatgtcgacgaaaaacaatatattttggtttttgaaaatttcttgtattctgtactaaatctcaaccaagcctagcccaaccggtctcactcattttatagatgcttcgaatcatatttgacatcttcttcttcttggcattacgtcctcactgggacagatagaacttcaatttcctccagatattcttcataaatccttcaactgaatcctccagttgttactctcgacgatcgtttttgttatcctaatcctgggccaaatcgcgagtttaaaggttccacaaaactaacatagattactaagaagcagtgcggagccgaattcaattgatttttttttacaaattcatagtaaaaaaaatcaattgaattcggctccgttatgcctccttgagagaagagacgaaccagccaagggctgaaagtctcgttaataaagacaattcattcattcattcattccgttatgcatgatggcgcatgaacctgttaaataaacgtttgactaaaaaactttggacgatgttccaaggattctggcagattataccaaaaaaaatcggcataggttcatttaagagtttttcttgacattcgtttatggatttcttactccaaagcattgctccacaaacttgagagaatattcgagaaaatccattaagaactttttcaagaattgttcaataaatttggcctgtgattcattagaaagttcccctagttttttttttctacaatttttcatcctaggaattcttctacagctcttccaaacatttctcaatgaatttttgaagcaactgcccatgaaatctccattcatttttgtttgagattccatgtcagttaacattcgttacagcattttttacaggaaaatacgtttattagggatctttcagaaaagcctagggaatattatgcagagatacgattttttttcaattatctttacttgtctaagccgttttgtaaatttgccataagagtctatgatttattttaagaaatttttatttaaaatgggtgattcaagcactatcaaaagtttatctggtggtactctaaggtttactgatgaaataacacatgacttatttgaataatgtcctctaatttttaaaagatttcctcgatatttcctgaagacgtggctggaaaatcttctgtgagaatgtctggataaattttgagcacttccttgaggaacatcttaaagaattattggatgaattcttacagaaatcttagcatgaatctttgaagttattcttataacgaagaacttcatggaatcataaagaaaaattgaaagaaaattttgtaggagatcattagaaatcctggataagtgtcaattgaattttcgaagatattctaaatgggtcttggaggatggcctagggaaatcgatggaagaaccacaggataaaaccttggaggacttttttgaaaaaagtaccacaaagaatatttggaggaattcctgatttgttctcagaagtaatttatgtggttatccttgaaaaaatccagattgtatttttgagatattctaagcaggagggattcctaaggataattcttgaaggtattccatattaaataatcactaaatgatgtcctgaaaaaaaatctttggagtaatacaagaatctttgaacacatacctgaaacaatgtatgatgaaaatcctagagaaaatcataaaaaaatgcattcagtaatacgagcagtattacttgtagtaacgtcccgaggaatcccaaaaccaaaaatttcgaatattttgaaagaaagtttggtctgattctatgaggaatttaaccttcatcctctcaaatttcaaagcgtgatcgtcaagagattaatttttttacttttgttacacagtgaagtattattatttatcattattcaagtggcttctgtgaatcagactatgaaatcattggacatgttggatcaattatttttttttttttcataatcagctcccgaataaatttaaaaagtttgtccacgatgatctgcttcaaacgggtatgcaagcaatgacttttcaattaatttggctggttatgcgatttcactacacaaaataacaaaatgtgtttttttatcctattctgccaaattaaccaaaaatatccattctttttgtgtttcagtattcaatttccattgaaattatttaaaaaaaacttgtttttcaaaaaaatgttgttttcgaactatttgagtaagattcgcacttttggctgacatttatatagattctgctaaattaaccaaaaatatccattctttttgtatttcagcgtacatttccattaaaaatactttcaaaaaaacttgttttgtcaataaataatgcttgtcgcacgatttgagtaagattagcacttttggccgacagttatatagattctgccaaacaaaacaaaaatatccattttattttgtgtttcagcattcatttccattgaaattatcatcaaaagaaaaaaacttgttttctcgatgaattaaactttctgaacaatccgagtaaaattcgcacttatggccaacgtttttctagagttcgaccactgttcggggtgaaaacgcattgcacactgcacccggttcttggctacttggcgcgttcgtatacctacctgctgcattccaccgcttcttgtaacttccaagttgcgcgttcggttggtcggttgctagagttgcgaaagattcggcgtgtgttctaatggcggtgcacttgtttcggcttttaggtgcccccctccccccctccaccaactcggaagggttctgaccgagtttctgcatcgagcgatgtgcgtcttgtcggcgctggaagttgggttgcattactagcaccctttctaagctaggcaaagtttgagaaccggttctgtgggtctagaagttttattcgtgtgggcttgatagaacttggcttctgcagaacgatgggtctttgggttgattgagattttatctggtgacatgcttgtcgggtaattggtcgaagtaattgctgtctgaagaaattgcttggaacggaagttggaggagaatgtttagagtttcatagaatgttttatttataattttttcttatacttatcattttttcttatactttcaggtacgttcttttaattatacaataactggtaatcgtaaatgtaagtataatgctaatagtcttattgaactctgtatacttaaaaaaagaaacatttcatgaaagattgtacagattttttttaagaaaatttatttgcatttatcatttttcataaaattttcttctattgagattttccttacaaagtttcataaaaaatatttacaaatctcggaggggtatcttccggaatctcagagagatagcctccggaatctcggagagatatcctccggaatctcggagagatatcctccggaatctcggagagatatcttccggaatctcgaagaaatatcctccgcaatctcggagagatatcctccgcaatctcggagagatatcatccggaatctcgaagagatatcctccgaaatctcggagagatatcctccggaatctcggagagatatcttttggaatctcggagagatatgctccggaatctcggagagatatcctccagaatctcgaaaagatatcttccggaattttggagagatatccttcggaatttcggagagatatcctccagaattactcagtgatatcctccggaatctcgctgagatatcatcaggaatctcggagaaatatcctctgaaatctcggagagatatcttccagaatctcgcagagatatttttccgactctcctagagatatccagcggaatctcagtgctataatctccagaattgcacagagaaatcctctggaatcgtggagatttgttgtatgtaatcttggagagatatcctccggatagcattacgaagaaacgttaagtacaaaaatgacctgattgactccaataacttataaatgcaaattgctagtcactcaatgatttctacctaataaaccttcaacaacctggtgttcggttgattctcggtaccgtacccattacgaagagatttacagccctttccactctgcattcatcaaatccttctcgagaaatcgtccctttttatgactgtaacggagctaactgactgactgactgactgaatcacgagtccggattgtcccaagacacgtcatcttacctgttagttgcacgcataagaaaaactttcaatcgtgacgttgcatcttacgattccacgacatcctgttcgcaagggaatcttcttcttgtgagttccttccacacaaacgcatcattcctcctcagtgagctcgttaacgcagccattatcagttcccgcgaaccgtgtgccgcggtacttcctcgtgctcgcaacttctccttgccgttgacacatttaccgcttgtcgtcgctgtctcctcaaactgcaccaaacgggtcgaccttgacctactcgttgggctccgctgtcgtggttgttgtgtccctaggtactgtaaattggaaagtgttaacagcagcagtgacaccttaaacaagctttttcgaaaatgtttgtgccagttcgtcgatggttgtaggtgtcttctaaattggcaacgagacttcttgaaagcttaattgttttgaaagtcttgtgcttcgttcttctatgtagacagctgagaggttttggatggttattgaaatcaaaccgagattccggaggatatctctccgagattccggagggtaactctccgagattccggaggatatctctccgagattccggaggatatctctccgagattctgaaggatatctcagagattccgaagaatatctctccgagattccggacgatatttctccgagattccggacgatatttctccgatattccggaggatatttctccgagattccggaggatatttctccgagattccggaggatatctctccgagattccggaggatatctctccgagattccggaggatatgtctccgagattccggaagatatctctccgagattccggaggatatctctccgagattccggaggatatctctccgagattccggaggatatctctccgagattccggacgatatctctctgagattccggacgatatctctccgagattccggacgatatttctccgagattccggacgatatttctccgagattccggaggatatttctccgagattccggaggatatctctccgagattccggaggatatgtctccgagattccggaagatatctctccgagattccggaggatatctctccgagattccggaggatatgtctccgagattccggaggatatctctccgagattccggaggatatctctccgagattccggacgatatctctctgagattccggacgatatctctccgagattccggacgatatttctccgagattccggacgatatttctccgagattccggaggatatttctccgagattccggaggatatctctccgagattccggaggatatgtctccgagattccggaagatatctctccgagattccggaggatatctctccgagattccggaggatatctctccaagattccggaggatatctctccaatattccggagaatatctcttcgaatcttccataatcccccgaaatctttgagagttgtcatccgaaatctcgttgattactgcaaggcaccctgctacgtgaattaatcagacagacttatttgctgccgtaacactttttttgtttcattaggggaattaggggcataatggacacgttaagcaaatgttcgttttaagaccattaaatggcaatgtttttaatttaccctcggctagttttcaagtttgatgttagtacgacgtgccacattcattcatagtgataaaaatcatatcatatgtcagaaaagcgagatagaaaattgggtcgaaaacaaggctggtaaaaaggtatcggggcgaaatgaacacctgcatgaaatttagttattccaatatattcaatgactgtcaatcattccgatatgcaaaagggctctccctcaatcataatagctaaaaagaacctttctgggatcgttactttgctcagaaattaaattcttcaacggtcttgcttatacgccaatttgaaactgagaaaaatttttagtcaaattttgaagaacaattgaagcaaaaaataaacttttataccgtcaaacatttcaaatgcattacagatttcatgcagtgattgaacttttgatgaaatatgcgtattatcagatattgagagggtgtccatttcgccccgtatgttcattatgcccctaatccccctacttacctacctgttctctgataagagtcatctctgtgtttgtctcgctctgttggtggctactccaaccccttcatatctccccctttctattctccatagttttttttttgtctgacgtctcgaatctaccccactaactaatttggcggtcaactaccaccgcaacactattgggttacaaaatagtgcgcgcttcgtcgctgacgacttgactgggaggaagaagaagactggtccgcccaaaacgaagaggatcacgtctaaatttatggatggttaaaaatttcataacgcccgcagtagtagtgggacggagccggacgaaggtcttcgtggcggcggcggcgatgatgttgggcaagccattgcgacgagattcggacggtttgattcgggtggaaaattttgtggtgcaatccgtgattgtgctaatcaatgaggttggtgtttagcgtggatttagtgttttagttttgaactaaagtaaaagatggttaacaatttgagaaggaatcgagatgcgatggaatctctgaagtctcggaaatatatctcttcataaacttgaaaagatatcttatgaagtctcgaaaaaacatcctccagaatctccaaaagatatccttaggagactcgttgagatatgctcaataacatgaagagatctcagcaagatcattcggaagcttgacaagatatccttcggaatctcgaagggatatccttcggaatcccgatgatatatccttcggaatcttaatgagctaaccttcggactctcgaggagatatccttcggaacttcggtgagatatcctctggaatctcggagagtaatcctccggaatgatatctttcggaatttcgctgataaatccttcggaatttcggtaataaattgttcggaatttccgtgagatatccgaaggaatctctgtatgatatcctttgaaatctcaccaagattccggaagtactctcaccgagatcccggagaatatcttaccgaaattctggaggatatctcaccgagattgcggaggatatctctccgagattccggaggatatttcaccgaaattccggaggatatctctccgagtttctggaggacatctctccgagtttccggaagatatccttccgagattgcggaggatatctctctgagattgcggaggatatctctcggagattctggaggatatttcacctgaattccggaagatatctctccgagattgcggaggatatctctctgagattgcggaggatatctctccgagattctggaggatatttcatcgaaattccgaaggatatctctccgagattgcggaggatatctctccgagattgcggaggatatctctccgagattctggaggatatttcatcgaaattccgaaggatatctctccgagattgcggaggatatctctccgagattgcggaggatatctctccgagattctggaggatatttcatcgaaattccggaggatatctcatcgagattcctggagatatctctctgcgattccggaggatatctctccgagattgcggaggatatctctccgagattccgaaggatatttcaccgaaattccggaggatatctcaccgagcttccggaattccgcatattccggaagatatctcttcgagattgcggaaaatatctcttcgagattccggaaaataactcactgagattccggatgatatctcgccgagattccggaggatatctcttcgagtttgcggaggatatctctccgagattccggaggatatctctccgagattccggaggatatctctccgagaatccggaggatatctctccgagattccggaggatatctctccgagattccggaggatatctctccgagattccggaggatatctctccgagattccggaggatatttctccgagattccggaggatatctctccgagattccggaggatatctctccgagattgcggaggatatctctccgagattccagaggatatctctccgagatttcggaggatatctctccgagatttcggaggatatctctccgagattccggaggatatctctccgagattctgaaggatatctctccgagatttcggaggcattcgagatttcggaggatatctcactgagattctgaagaatatctcactgagattccagagttaccgagttacgtttttaccgagatttcagagaatattccattggaattccgtacgatatctcactaagattccggagggtataatgtgatcaaaggtctgctccacgaaaaaattcaacctttcagagtaatgctctcgcaaaatgatgccacttgtgtaaactaggaaattggcatttccagctacaccaccaatcaattccacttgattaatctaacgcagtcttctacaacccatccgaaatagaaacgcatcatcgtactcttctcttcgccggcatccatcgtccactcagacaacgagacggctccgtagttcaattgtacgcagacagaccgcatcccaggcaggcagtgtgaatccaaatttgataagattatcagccaacgcgcacggtgacctacttttttggcagccgatcggtattgcacgttgcgcgcctttttttccgccgtccttcgcccccttttgcgctattcgctgtgcgatgttttgcctacttgagctggttgtcgtcgtcgtcatgcgttcattgtgcgtctgttccacttgtctccaattgtggtgaataggtgacatctggttggtgagtgtctgcgtaattggggttttgaggggtgttgagtgttgtttttaacaagttgaatacaacgtgaatactcctcgcaatttgtaaacaaactgtgcacgataaatcgaaatcacttaaatttgtggtaaaaatgtagctgtcattatgttctccggctttccatgaacgaagtagagttattgtgatgtttattgatatatcgctattaaaggataagtggagtgtagacgtttttcaaaagtcgatataaaaatgaatgatatccgcttcataaaatagccgcgagttcgaaacctcatgtccagacagaaaatgtactcattcaaatcccaattctaacatttggcgcgatttctaaattgtacatgaaaaattaaaataaataatcgtcatgacaacagcaacaaacaccacagctgacaacagcagcctgcttcggtttcgttcgatcaaaaaagacaacgcacaaatgacggacaacgacaacgatttccaccacaaacatccgaaaacaccattcctaccacccgcagtcagtcatcggcgatggcggtggtgagttattatacaaagcagcgagacgactgtggtgaagtgctgaagtgtgcggcgggcgcagcggcgaacagaaatttgggtcaaggtggaccgaatcaataaaatttcgtgcacagcacacacaaacgagtagtagactacacctcggtggccaagagtggcgtggtgaggaacggcgaggtgtggtgtggtgcacagcgcgagttgtagtatactccgttgcgaatgattaagtggtgaagtcgggtagaaacgaaaaaaaaaacaccacacaaaataaatgctcgcacgagccaaacaagtggagtcttggcagaggctaggaggaaaatgtggttgtttgttgataaaaaagaaataaacccgcttggggttctattttggtattttccgagagcataaaaacagcgtctttccctagtcgctagtaacatggtgttcagttagtacatatatgtgtgcacacatatgtttaaggctttgatttgggtaatgacggattgctgcgttcgacggtagcgccacagggttgtggaaaggggaactacttttccgtgacagatgcgtaccgtgcaccgtctgtggttgattgatgaataatttagcgactctgatgggattcacaccgaagcttgatgtgtatctgttttgtggattatgtttgagtcgttattatctcaatttgaagcactagatatatcctgcgctcagtatcaaaaaggcgtaactgcagtgttcgattttctctttagttaatcacttggccgggcgaatattttcgactgttatttctgattcagtagaaactactgatcgtctttagtcattcttcgtcgaaaaatgttccgaaaattgattgaatttccaaagagaatccaaatccaaagagaaaatcgatcactgcagatacgtctatatgaaaccgaacacgagattatgttgttcttttcgaatgctacaattttggatagaattggaatgattagtctcaccaaaccaacgcctacttggagctgaaccttagaagttcaaaatatgaactgtcactgtcagccgataacaatggacaaacatgatgaaggcgcgtaattgatccgaacatattcatcaaaggtgacaaacatcgaatgagaattagttcatgcacattcaaaagtattgtcaccagagcatccttaattctgattaagcaaaaagtatggcattacgcatcatttcactttttcaaatagaaatgaaaattaaatgcatagaaaactgtggcctttctaccatgtttgtccggaaagttcgaagctgcgaatcaaatgaaaactagcgattttcaccaagcctgccttgattgtcaatggcaagcaggagttatcttgcagttgttacatatttcgtgtgtatctgtgcctccctctttaccctgggaaggataacagttatctatgctaggacaaatatcttctgaaaagctgtgtaaagattcaaactgatatacgttgaaatcattatcgccgccacacagtgtattgtgtcaatcagttgtgaatataagcattgttgtcacacgttcggatatcttcggaccgttatttggatgggagttagctaaagctgtaatttaatgttttaatttgttattttaggttaactttaacaattaattttacctacatttactagtccttcggtaactgatcctttctgttgtaacaacttcaatcgtgtgttgcaaaactatgtaattgtaaattttcattgttttaggtttaattcatttatgtacttacaattcaccagtatttagcttagcttattaataaaattcaattcgcttataaataaattcaaccgaaatagctcgaatcaactcaattacgatgactacacaattctgttttgttttgtcttttcatttccttaccctatcggtagctatacctatgtgccctatcagcagccaagcagcaactgtgctgccagattttcaatctaccgcgcgcgaatgggtttggtacattacaccgcaacacttccccgacccataaagctagttggacatctaatcagctttactagcttcaaactccagtcgtgctagcttaaccaccggccgctccattaacccgcctgctgcctgcaccacggctactcgtactcttccatcactttcttctttcaccttcactactcttccacgtagccaaccatgcctgaccgatcactacgatgcactacgatgaccgaatcgccaacttcaatcggcctcacttcttcaaaccacttggttcgacgagcgatggtcggcagatactctgtcacccatcttcttcaaaattggtccatcatagagcggcagagctcccagctttcgcggcataccatcttcggttccgttgacgtctccggagattgcaccactcccgtagaattcagcaaaagaaaatggttcggcgtgagggccttttgctgctccgtctccaatggaatgaacgttagaggtctcgagttaactacgctctctgcttctaccaccaatgtcgccaaagtttcttccttcgaaatctcggtcgtctgaatcgcctctatcgctgtcttgactgaacgcaccaaacgctcctaagcgctacccatatgcagcgcagctggcgagttgaacacccatcgggtattattgttaatgaatgtctctgcgagttgctgatccatctccatcttctccttgcccaggtcgttgttcgtctctacgaaattcgtacccctgtcactgcgtatctccactggagcgcctctgcgtctaataaaccgtcgtatcgcttgcttgcacgattcagtcgaaagcgaatgtgcgacctctaggtgtactgctacctctcgtattgcgacgcgtagagctgatgtatgaaacctctgtctaacttcgttaactaccgtttcattattggcatgcaggaatctccgatgataccattccagcagccatcgggtaactacgggagctttcggaagaatgatcggcaatctcgtgtcgtatgacacaaaggtagcagcggaaatcctggactccgcaagaattactccgctgtcgtccacgtacggattttactcgttcgctccagtctgccgcactttgtgcccttctcataggaaacgattgccatctcgtcgggatactgctcgctttgcaccatccgaaatatggtcattaccgcttgtgctattgcgtgctgcctcagagctccggtcacttacggctccttcttgactttcggctgcagattctcacaaaatcgaggatccagttgaaaaattgctgccaatcttccaccaacgtcacagtcgcttccgtgtgcactagacatgctcaaagcttttcaaccgttgttattccgtcggtttcacaccggtgggccactccgtttccggcgaacgcgggaagtttggttcgctgaaccaacggctaatgggaaataagcatggaccttttccccactttgtagccagatcttttggattttccctagtagataccgaacgccattgtgctacgtccgacttagaaaggatttcacctacacggcatgcaacgaatagtcggtaactacgatggtccgagttaatccatgccaatactgtcttcgaatcactccacatgatcgttttacctatcttcatcgaatgtccgttacaaatggttttctgtaggcgaactccgatcaccaccgccatcagctccagtcttgggatcgatagcgccttcagcgaaactaccttcgcttttccgccgatcagtgccacctctataccgtttacgaactctgctcgaaaatacgaatcgcaagcatacgcttcttcgctggtattaataaagatgtgcaactgcagatccaagatttcattctgcccgtgctgaggaaaattacaccgaggaacgcgaacttcaactaaccattcaaacatattcgtacagcgcgttcacatttccttctgctgcatcggtatcccctggtccaaattagcttttgatctcaatagctcctggatcaacatttttccgtggattaggaatgaaacatagcaacccagcaggatcgaacggactcatcatgactcgtaacgttttgtgggataatccgtatcgattggcaatgtagttgaaaaggtgaacacgtcttctgtacttgtccaactgtagactcttttcagcaatcgcattactctcccccgacccgtgcgagcatctccttcgagtttgacagccaattgcgcaagtggaatccttcgagagagtggacatgtcggacatcagacactatctacaacgcttcgtcgacactgtcagcgcagtcgagataatcgtccacatgtttccgaatgattgctttcgctgctttcggatactcttcggcgtttttgttcttaacgaactgcgtcgaacacggagaacaggtaactccgaacgtgatgacgtccatcaggtacacgtccgggatttgcgatgggtcttcacgccattaaaatcgttgggcgtgccggtcctccggccgaatctgaatctgatggaaaatctccttcagatctgcacatagtgcgatacgcttctcccgaaatccgaacaatacgtcaagcaaagtattcagaagatccggacccttcggcagcatcgtgttcatggagatgccgtccactttagccgccgcgtcgtaaaaaatcgtatattcgacggctttttgagattgagctcctatcaagaagatatcatgtccgcatcggatctgcttaggtgagctcctcctgcgtcgctttgtaaattgcctggcaacaagcatctttaaatgtttcatattcaccactcggcttatagacaaaaggtcgaaagacaaaatgtcgaaaggacaaaaggtcggtggaaaatttttcctccttttaaaaaagattttcgaccttttgctccttctttttgttcttcgacattttatcctttcgatctttcgaccttctgtcatttcgacctttttcatagattccaccactcatatcgtcttaggaatttagcgataacagcgctaccacgttgttgctacttgtgttgccattttaaatttccggccatcgttttgtaatcggacttgatcgtctgtggtaaaacattataaaacttagacagaaaaatcacgggcagaaaatcttcaataaatttcaaagacttatcgatgcaaaatctctaatttggtgaagttttttttcaattcaaggaaattttgttgcacatctagaacagattttgaaggaaatttcggtgaaaattcgttgaaaacctccttaacactacagttgttttgggatgctaagtaaaagtaaatataagaaaaaaaacatgaaaacacctcgctgaaagtcttacgaaaatgtaggtacatctccttgattcttcaagagttcttcaccacattgccgtagcggtaaacgcacagctattcagcaaagaaagtggatgcagaaaatattcaccatgtataaaaataatagatccaattttcgtcgccacacagcgtattgcgtcgatgagaggtgaatttgagcatcttgaaatattttatattcagctctgatgtcatcttgggaatttaggtattaaccgcttatttgtctcacacagtagtgtattcggacttgaacgtctgttatctgtggattaaccaaagttcgttatcccttccctagtacgtcactagggtaagcactgttgatttgaggagtaatttacaatttatattctctaggatttattgagaattttggtagaaaactgttaagaatattgccagaagtttcaaaagattgggctgatatgtcgttatctagaaacatggaatttagatcaaaaataaaaggcatcctgcaaagactacgtttcgcaagatgaaatgtgcaggtataaaaacggtagaatctcaacaaaggaacgcaactagggttgtcatgtcttttacggcttaaaacagccgaacatattatggttgaaaggtggaagcgtcactacgttgaacagctgaatggtgaagagtagacgcagaacttcatgatagcggacgttcgacagctgaacagcaatgaaactgttgtcaaagatgctatcatagtctaactcatcaaatggacccgaaaaggttgaccactctttccgagtctaatttgagattcggtctacaatgttaggtttataatattcgtggaacttccttgtataagttggtactttaaacaaagtggtgtcttggtaattccagtcctgatcctgttcgattgactccaagttgtattgcctaatattcatgcgcatacaacttcaccataccgcaacttcatcgcaccttcttatctgagcaaatgttcaaacgaatcgtattgtctttttaagcataatacttcccgcattcagttgactcaaatttcataaccaattagcaaactgtacagtccactttcctaaagacaagagaacactcacgttacgttacattgcgcgcattgtgtgtaacaccgcggagtttgttgtgcgacaaatcggttggcaaatatgtgcaaaactcttcgcactcggtcaactcgtcattaacatcatcgacgatggaatctccctcccattgcatagacattgaatgcggtgcatagcttagccaaggatgacttaccaatgttggctcacattgcataacagagccgccgctgcaactccgatccgagtgcgacgacaacgacaataaagatcaacgtgacaagcatgctaattgatggtgcaaacctcctttccacatgcaactacgggcaaacggcaaagccatggtagtcattaaccgtgaatgccaaccgttgtgcttcgaatcgagagctcgggaagttgtggaaaaaaccgatcaactcacttcggcgcaagtagaacttttctcggttgatcgataaagtagagtgggtagacgtggccggcaatggaagtttgcatgatttgaggttttattgtgttcttttagcagttgtctagtccaaaattcgtctttgatgcctttgtaatcaaccaaaggtaataaattttcaatatttccctgaatcatatcgattttgacaaatatcatgcaattgcttaactactacagaaagtaatgcgtttcatcaacttaatttaatttatccaatcaaattaaatcaaactatcgatcattacgattaaaacaacgatctcgaacccgtcaatcaccgattcgagtcgcagtaaccgtgtcaattagtgggtcttttctcgaacagtaatttcggggaccacttttcggtggcgtaatttgtagatgacctccaccgaaaaaaaaaccccaagagcgcacattgttgtcggtaaacgtggtgttgaaatcaatgtggcaccgctgcgctacgagcgcgtacctagctcattaacaacttttcgagtttctccctgtgcttctcgtcaactctacctgtggccaaggttgtgcatctgttgctggtgtttgttggtttgtggttcgagtgttcgatttaggtttttttttgtagagttttccaccgtcgtcgacggtgagtaatagaaacagcagcagctcactaattgacgatcggcttcgaacagggatgctagttcaaatcaatttcaatttggttgggttcaaaaggatctctgataacaaattgacacatgtttcaaaaaggacatagttctaccagacatttcattgagcgcacctaatgtgcgaatcatcaatttgtttaaaaacaaatcaatgattgtttgacatctaaccaactggcaaccctattatcagtttcacctcaacgattataacttcagtcaaaaactatacccgaattcaaattgaacccgggcagtggttttgggccagtgttgttgtgtgtgtgtgggtactgcggggataattcggattgagaaaatttcgtaattttctctcgcgcgtcgttggagatgacattgaggttttaattttttcgccggtcgactctgttggtcaataggttgcgaatggatttattgctgctgctgctactgctgctgttgatgatgcggtgagcatccaatttgctgttgcgcattgtgaaatgcgatgtgcttgacgagatttggaaattcgggtgtttgatttagtaatgggtcgatgatttagatgacggtaatgaggagatgatgatttttgtggaaaatgtaatgaggaattctttccagattttttttaatgatgtccagatgattttcagtcctcctctgctcttatattgttaatatttctttattcaattttaactaaatggaaaaatggtcacttaagtcactgatttcgaggtctcatacaaaggcttgatcagctttccaaacataaacaggaagaaacatgtacttgttattataaacacaaatagtgtgattaagacatcaaagtgtcataaaagatatggattctcggttaactttctggaagaattcaggtgaaaaaatcggagacttttctaaaagcaaaaatttttggagaagattttggcaaaactcagaagcgtttctgggctgaattttctggctgaaatatttgaataaattttagcgaaaacccggaccaatatctggcagacctactgaattattattattattaactttatttacgagactttcagcccgtggacctactgaataagtgatttttctacagtaagaagaaagaagataagccagagaaggttaaaaataacaaaaaaaaaattcaaagggtttgtccagcactcaaaagcgagtgctaatttggctagaaatcatttcagaaataacattccaccaaaccaacaatacatttttccatcgattattcaactaattcctaacaaatttcttcaactaactccttttgaaattgcgagtttgttttccggagttcatgtgattgataaaccacaagtttttttttgtgaaatgaaaagtgaaatgcgccatctttttgaccatttatggcaatcatgttttatcccggacagataactgttgaaaaataattcaaattagtgcagttttctgcttttcaaattcacccaatatgtagattggttcatatctacatagaacgcaattttatttgtagtcaattttatgactaatacttttagttttgaagtcacttcttggtcactatttggtcactcttttgattattttggtctctaaaatcattattattttgctgtctgactgctaccagccctagattttgtacacttcacagtttgaccatttactctgtaacatctaaaacctcttatgtatcattactgattaaccctctaatacccaaatttttattttcgatctaaatatcatttttagttatctaaaatcgttcttaacacgttttgggcaatgatttatttttattagcaaatctatgaattttggtttttgatttttataaattttacttttgatcatccctatcctttttaattttttcttgtagcctcttctagttactgatttttggcaataataaaaattcaagtttttacggtacttttgaaaatattatatttttaatatttttctggaaatatgtttatgttccgtgtaagtaacggaaaaccaggtttgaaattattttaatatccccaagctgttcttctgtgataggttgatagtagaaaaatataaaaggtacaattttctatattacacgttaaatgaaccccatgcatttgtaggttatataagaatacaatttttcaaacaattttcaaaaatacaaaaaactttcaaaagtcataaaaaacttttcttatatgcgtgttatgagtcaaggttttagccaaaaataatatttttttatttccgagctacgaaaaaatacacaacattccaaagtgtaccccgtctaaaggcggggttgggtattagagggttaacacttttgtattgtgtatacaatttggttatctgcaaagttgttcaataaatgaagcttaaaatgtgcagtgcaaagctgaaaatttattgattttttaaatcaaaacattttgatatttgaaatgtttaaggtttgtgataactttgaagtttgtgatgtataatcagaacagatagttcgatatcgctgttttgttcatattttgtagagagccaatttaattttcaagcgaccatttttaaacaaacaatagtagaaaatctttttcaacaaaaactcgagataaaaaagcaaattaatttacattaccttaattgattagttttttttatttttcccaaaaatgtcatttgaaaatgcaaatgttgcatgttttatatttaaaaaaacaagtactggcaccaatcgcttgtgacaatacactgtattttgttttctgaaagctttaagcatgtttagaaatatgttttagacgtttttttttatttatctggcagcgatgatcacacatgaaaataatgtccggtatggtagaaattatcgttatattctaaaatcatagcccctaaaaccggtgttgattgccaagaaattgaaagtcatttactttttaggatattttgaaattgaaacaccatgattcgcgaaatacgtctaaaagtcggcaatttcctaaggacattcggcagtctttagaataattcgttaattttactaaattgaacatacctacaataattttgacaacggaatcgttttaagggataacttttctagtagaaactttttcctcgcttatatgatttacagaattcatgtgaagtatgaatctttgatagagtcatccatacccaaatagcactttaattcgctatagttctgatatagttttgttatacagctgacatggcctatattagtcgtttaatagctctataagaccaaaaatggaaatcaaaaatggttacttgagtaatcaagtaaatcaatgtttcgataagtggaaaaaaataagcacaaacaaaacttaatttttgcaaaaacctgaattttcagaagctgctgaatgtacaaaatagaagcaccgtttatgtatttgaataattaattatgattcgtggtttacagctaaccagccgagtggaagtttaacaactactgaaaaactaaacattgcatagggaaggtgtaccgatattgggcatgttccagttccccgttatataccgttttacgacatatatggtttccaattgttcagtgtgcgctaaattgcttcaagatgatacggaaacattcttggaaaccgcaaaattttctcggaaaataatagaaaaaaatcattttcctcaaaatttttgctcctttgcacctatttttcgccatggtgttcccgattcgccaccctccataagaactcaacgtaggtggcgaattcaggaaccgaaattaaaatcgtggagaatactggtgcaagtggtccagtattcgccacccccattgttaatacaaatacaaagtttctgattagtttttatatttttcctgctgagcatgtattgaaagttttcgtttaatgtattgacagtaaccaaaggtcgtttaatttatgtataaacaatgtttttccttagggtggccaaaactggtacacttccccaatattttgcaattggattaaatggacaaacttttgtgaaatttgcgaaaaattttcacgttttctcttctcgatgagaatcgaacacgcgactccctggatccctaaatagggccatttatgtgttgataatgtttcatgtaaaaatattgattcatactttttacgaggaagccacattgaagaatggtaagctaatccctagccccattcactaaatccctgtgcaacttcgattgctctgatcaatcatagagtagcaactacgaactgtacagttatttatgctcaagctcatgattcaaactttttacgaggaagtgcattccgatcaatgttacctcatttaacggtatttatattttttttcatgacctcaaaatcgatggaatcgttggatattggtcgtggttgttatatgtttgaagaaattaacatgagaaatatccaagcactctgattacagcaaatactccaactttcaagattctactccattctcccaaatgtcatcatccttttttttttttaatttctttattagtatcattccaaacattacattcattatttcttatatctaggtgttctgtgttattagacaacactatcatcctaatttggtaaaaaaaatctaagattttattaacattttgttaacaacatattatatttcatttgccgtagcagttcagattttttacaggtgagttgatttcacctgcttatacgtgtcatcatccctaatgaaccataactccgaatgtcgttaccctaaatgtaaaattacatcgaatgacattaacctgtaataatggaattcagggtatttaatgcaattcggggatatgaaattcagcgtgacagcattcggggtaatggggtagaatctttcatagtagcttgaacaggattaaaatagatttagagaaaattcgatcatgaaaagttggccagaaaaagtttttcgtaaagtgaggcagacaaaatcgtatcggtactgtcgttcaattaaggttcacgaaaagcgtaaatgtgttgacattttgttaaacttccaatcttttttccaaagattttttttatcaaaattatgaaaaatttaaaaatggaatatagggagattaagggcataacggacacattaatcaataagtatttgctttaaatggtaaaattttattgttaccttcggattgttttcaagcgtaatattagaaccacgtagaactacgtgttatatttatttataatgataaaaaatatatcaaacgtcagaaaattgagtcgaaaacaaagccggtaaaaagttttcggggtaaaaagaaaacatttcaggaattaggttatcataattttattgcaaaagtcaaaagtaccaatatttaacataacacctcaaaattcattgtagtaagaaaaaaaattctctgcgatcgtaactttgttcaaaatattagattctttcaccaccttgtttatgtttcattttgaatatgagaaaagcctaaactcaaattccaaagtacaactgaagcaaaaaataaacttttatacagtgcaacagtgcagtgaatgaatttttaatgaaacatgcttatttccagagatcaaaagggtgtcattctgcccataattcccctgtatgttctctatctcaatactttctctgctcttttcaatgtcgagtaagaaagagagagagagtttacttcaaatatgttcaagaacatatgtaatacgatagtacgacattcttaaattttctatgtgtgggataaatttccctattaccaatgtttattatagaatacgtttgcctctggttatagttaaggattttccaattattttttttttacaagctcaagttatttaatttcatctctgaaatattgtttcgttaaaaataaaaaaaaaatagtcagtagaatcatgtttaaaatattttcgaagtatttaatttttttctaattttttgacaccacctttttaaaattaatattgcctgcaatctgatgaaaattacaatagcccttggttgaacatttttgccgaaggcggcatccttctaaggtttgaggatccaaagatatccgcgaaacaaaagtttcatgctcggtggtgccgcctagtgacaaaatctcaaatttcttggctcaaataatgagagctcttgagctattgaacaactttgttgaaggcgccatccttctaagtggtcagcctcctgagaaatttgcaattacaatcattctaattctcttttcgttctcttcattacaggtatgcaacagattgattcgaattcgtttatacgtaagtggactaacatttatatgaagacaaaatggttcattctctacgaacttagaaaaaaataatgttttctgatatgtaaatctcaaagcacaaaccatgtaaatttactagactttgtgtgcaaaattaagactgattcgtgtaaaattcggtctagtgtgaaccgagggctgaattctgagtaaattgggagtatctcgcactcatcgccctctgtaacaatcatgatctgcaacacatcgttagagtctgtttatcgtctactgctacaactctgattagatcggggagataacagtgcatgataatacccatctaaacaagctctaaacctggggagcactatcatgttctgatattgtttatcatgccagtaaagtaaaacacctaccttcaatagtaaataagcgaaagaaatggattttatcatcactttatctttgcggcgctcctacgctgctgccatttatcaagcttgttaaaacttgcgaaacatcgccgatcatggaccgatactgttgcgatgtttttcttcgtttgctttgatcgaggatcgaaatcaattgagaacgaattctgcaattcctggtatgaacgagaatgcttcgaggttccgaaacactactatgggcagtttccttgtagactggcggacaaaaatattgttctcagctcatgtcatattaagaagttaagtgctacaaatatgatgttttgttttcaaaaacatgttttcgaaactatcttttgaaaagagtatatagcgaaatactgatttttgttaattatgatgcatataggacattcatgcggattacgttgtgtaaaccattataaatataataaagtagatatttgaaatctgaatgcatttctgaaggctgctgaccgaagaaagggcgataacgttctctacaggatttaaataaaatcacacaattcaaagaagattatctccacgcattgtatcgttccatggctttgatgcactcccagtagcgaatcgaatccacaaataaatccgattccataaaaccctacgacctgcataacgcaccaatagcccatcaagggcaccgagttccatttctttcggagaaccttgcaaatgggaacattccttacatttccccacacacataagcatcgtggaatccggcaccgcacatgaagcgaaacgggaaaataaaaatgcaattctcctcaatcgactccctcaaggagaagggaatcttctctaatcaacagggttgttagcagatttttttcgttaatcaaaactgttgattaaaatcttaaagaaatatacacatccgatatatctagattataaatttctttttttctgaagatgaagaagaatcttagcactttaataatctttgcagtgttttgtggtgtaaatgcttaatgatcaagagattttttaaaaacactacgtgtatcctccacaggttcttcgttgattcgtagaacaagagctacagaaattcttccaatgattataccaggtaataattaattacatgtaggaactcatccaaagatttttcaaaaattcttctatagatttctccagaaattcttgcaggtatccttccaaaaaatcctcttatttcactaggtatgcttgaatgatttttttagaacctttcaaccgcacaatgatgttatcttcagtaattttgtcaggatttgttctgaaaattgcattataatttcctgcgggaattcttgtggtgatttttccagctgttacttctgaaaatcttttgatgatttttaaagacatccctccaaaagaacccacaaggtttttgtccagaatttctgaagaaattgctttatattaccggcaaattctttaaaaacacattcaggaactaattcaaggattcctccaaaaatccctctatagatatctagagaaattcttgctggtatccttccaaaaatgtctctacctatattacaaggtatgcttgattttttttttgaatttttgtcagttttcttatgatttcctccgggaagttttcgaataattcttgtagtgatttttccagctgttgctccagaaaatctttcagagatgatttcctccgggaagtttttgaataattcttgtagtgatttttccagctgttgctccagaaaatctttcagagatttttaaagacatccctactgtagatcccacaaagttttgtccagaatttttgatgaaatagttaggtgttattcctctgatgtttttatttaattaaaatatgagtgtttcttacaaactctgaatctcaattactcccactttcgccaagtttctatcacttccgccccccaaattacgtcttacaaattttcgcccctctggacctgaaaatcgcccccaggggggcgaattcgcctactttgggaatcactgctctagagtaatgtttgaacttttttcagatattctagatggaatctctgaaaaaaaaaatcctagagacaatttctggaaataacctgagagaaatcatagtttgatttcttgtaggtttcgaaacttaaatcttgtaggaacaccttgagaaatccgttaaatattaaatggatgaatactggaagaatatagggaaaactactgagctaatgtctgatggcatttctggagaaaataatgaaatacataagttaatacttagcgaagttttcttaagtttcttttgaattcctgttcggtctaatgcatgaggtatctaaagttcttagctttcagatactctttcgctaccagccccataaatgtaagtaatttgtcataaaagtgcacaactacatttggtgttccgagaagcacttaatataatctttaatgatgctttcaaatgtcttttacagggctggtagcggccggacagcaaaataatagtgactttagtgactaaaattatcaaaaaagtgaccaaatagtgactaaaaagtgacttcataactacaagttcagaaacgaaaacattgttttaataatcaagaatattaacaaacctacacattaggggtcatgcacaaattacgtcacgctccaagggggggaggggggtcgagccgagcgtgacaagccttacaaaattttcggaggactcatacaaaaagtgtgacaaagggggggggggggggggagggagtcgaaaaagttgatacttagcgtgacataatttgtgtatcatcccttatgtaaaattaaaaatggacttacagagctaggcatatatatgcaaccactctaaatctcgaattacagtcagcagaatgtcaaaattcttaagcattaaggttgtgctacttttcctcgagtgtcgtttccccgaacgtcagttccccgaataatccgcttccccgaaaagtttttgaaactgataattgtcatagctttatatattttagggtagtaaacgtactggtcatctgatatgcaccctttatttaattggcggttcttatgagttttaccgtccttggcaacatgtgtataccgagttttaccgtccttggcaacatgtgtatagtcgagaatgaccaaaaacctccttcttttgatcgtgtaaattgtctcttttaaaattgtctcttctcggggaaacgggtcattcgggaaaaaggcattcggggaaacgggtcattcagtgaactggcgttcgggtaaccgacatttggggaaaagtagcacaatcagcattaatggtgaaatccattgaagatgcttcaaggttgtgtaacgagatcatgaataaacatgtttcatgcatgtcttaggaaatttcagcaaaagttcgagattaaatttacgatggtaagggaagattgtttagcattccttacaaaaattgtagctgaaatccagggcattctggtggaattcccggtagaatcgagaatataaaaatagaacgggaacacccagtaggattttttttttaatttgactaacgcatccacaaaatagcttcaaagcttaatctattttcgactattttcagattataaaaataatctgaatagtactcactgaagtatccaaaacaatcgtatcactaaagattaacaaataatacttattttaaactgatttcgaaacaattagcccatgtgtctgagtgtgttttagaaatgattatttctattccgaaacacgtatttggaaaagaaatgagtctattatctttattattgagactttcagcctttggtcggttcatctccgcgagaaattagtcgttcaaaatcgtagagataaaatagtagctctaattcgcgagaaatgtctgccgttgatttttctagaaattcatctaaataaactcagcaggtctgtcagaaactagacctacatttaaatttcaaaacttttccagaacttttatctcgaaattcatcaaatacatttcaaatgttctgtaggaaatgcctgtacaatattcaccagaaagttagcaaagaatcctttctccttcagacactttgatatgctgatcgaaaaaaagttacaacaataaaataataaaatcagtaaagtttttttgtcctgctattaagttttaagaagcttatccaaattatccgttgatttatcatcagatcaccaaaaaatagtgactttagttaccatgtttctcaaaaaagtgacctcagtgactttttgttgaaaatagtgactttttagcgaccaggtcgaaaagagtgaccaaggcactaaaaagtgactcgctaccaggcctggttataggtttggcgattcacagcagtaaatttaatagagaacaatttccaatagttgactgacagcagttcaaacaaacatttaaagctatcaaatttattacaaaagcaatttaatgttcaatcgttgaggcaaattgataaatcaatacaaaacaaaaatgtacagagtgataactatttcctgccagtgaagtaaatgaacttggaaaaaattgtttttcactattgaattaagcaacggattcggcgcagattaaattaacgaataagaatttgaatattgaatgccatgaatactatgttggatatctcgtaacaaccttgtgcatcaacttaacccatatgaatcgttcgaaccaagccttgccatcgttcacaccccacttctggtattagccagagataaaagtacatactagtccagtgctgagtccccttgctcgtggtgtgacattggcagcatcggcggtgaacttgctcccattgctgctgagaattgcagattgttttgcatttagaggagaattgaatggattgtggagtagggcggatcaaattataaaataggttgaaagtccaatctcttctaggataaaaaaatagtgttctgtgcaattttcaacattttccgtggtgaatttaagatgatccaaagacggagtaggtttatataaaaatttgtgtggagaagttttgaaaagtgttccaaatacgttaatactgctgtttagtacaaatttatcatgttaaagtgaaaactcattcttcaaaccggaataaataaagttactgaatagagcagttctatccgacggagtgctgttcataaatgtgttgctctaattgaactcgatgtgagaatataatcctgtaaagttctgcaaaacctcaaacaaaataaatatgtttcttcagcttctttcttcaaaaagacttgagaaaaaaggttcgatgatttatactagcatctactagactgtgatagttttaccagtgtttgaagtattattttagttttttttcatatatcttttcataaaccattaacgtctttgagccatcttcaaactttcactaaaatagcttaaaatttcgaggagttctatttatatcataaggaaaggggatagagttttgaaacttttttttaaatgcgaatcgccctattgtgcagtaatacggtgcggaccggttttattttcttccatttctcctaactccacattatcttcgccggtcgtcgtctattgccatggttcaatgttgcagagcttgcagagttcgcccggagttttcccattcaccctcagtcactgctggcgctggctgggtctgctgatggctacactctctttcactttcaaccagtttgcctgcgccactttgtggggttccaacgccgaggggtgaggcatttgatcgtgaccacgaccagctccaccggagccagcgaggttcgggctgcaggagaaaatgcgatagagtgaaaaaaagctagtttgcaattatgttgcagctcgctcgttcggttcaggttgttatgctgttgcgcgattcgaccttgagtctagtgtttttttcagcattatgcaagccaactgcttgcttgtccgatcggttttgtttagaaatatggtggaagtggaaacacgcaaaccggcattacttcggtgcggtgttgagtaattggtaattgaagaggcttgcgcttgtataggatcgatgggaagggaggtttgaagcggttgtcggaatggaaatgattaattgcaaataattgaacaaattgattgggtgagaaagtttcgattagaattgttctgaaactgaaactggaaatgtacattagggagatttaaaattcagttaagtttgaaaaccccatctcctttaccaccctcacgataaaaatagtgttatgtgaaattttaggctttttcggtggtgatttaaaggtgacccaaagatgatgcaagtttatatggaaattaaattaaatcatttgaggggaaattaggtattgacttgtctgattttagtcaaaagttaagtcaattggcaaattgatacttactttaaatttagtgatttccagtttttttttaataagaatatttaacaggaggttaactattcgtgatcaaacttcatcatcccaccgcaaaattgctagtgtttggaggcgatgttttcttccaaaatgcgaaaacatcacctctaacttagttcttatactcgccaccgcatgaattatggagacgcgtcgatcgtcacaagtttctcgttaaacagtcaatagattatccacgctcattcctttattaacaatttgttccatgcgaagcaaacgcaaaagagtagcaaaccttgaaaatatgatcgtggcaaattgtataattgccgccggattgcataaaccaccgcgtgcacgcacgaagaaagtgaaaattacgcgccgtcatgcccgccaagcaaggtagagagtcgacatccaactcccgccgacgcggtgcatcgacgacgaaccggtttgtatgagtcatctcaaactcagccatcgaaacgcaacatcgcgaaactcgtgggtaattttccgcccacaatttcccggtaacccacaaaccagcagcgcatcaaaaaacggaagaagatgatgctgcgctcaacactacctatggcgtcagccataggccgggccttacctcacctgactctcactaggcctcaaccaaccggcgaaagcagtgtaatgaaggacggcgagaaagcatctcacaagcactcacccaatcgctcactcgctcatcggggctgagtgaatagccagcgtctccttgatcgttgatcgttgaaactcagaagcgtgcactttttgaaactggttgttcccaccagtcgagtcatgacgacgacggacgaagggcgcgccggcaccgtgaaagcttccagttttctaagccgggaacgcgagaggaacagtgcggcggcatgcgggtacctaagctaggctcttattgtgctctgcaagataaatccacgtaatgcgattatttgaaaatgtcgatataccgtcgcagtgataatgaaaatcaataaatgtttcagatttagcaaatttgaaacatttgtgtccttgaagcacgaaaaaatccaagcctacttgaaatttgacgttgcgtttgaattgcgcgcatatcttctgcgcgttaccgccgccgctggatgtggatttaatataagcgccgcaatacagcatagaaggtatgcgcgctttgcgctgctgccattgcttaagggtatgcggtatgctatttttcagaataattaaaagaatcgttgcgaaatttagggacccctagcaagattatgagggctagaaaaatattttctttgaattgagcgatttctatataatagaatgattagtgtaatcttgaagattcggagtgcgaaattcctggggattcataatggaattcatctaaattttaacacttttatgatgggttctctttcaccaaatctggggtcctagtggcctcgacctcctgagaattcttagaatttccaatcggatctcaagagattcatagcgacatcctcagaattttcagcaggatctcctgaggatcacaaaaaagatttatggtacagtcaccccacgcagttgaatcacccacaatttatgaatcagctgacttcaaaagacaaaattattatcaaacttgtcacaaaacatcacagaattatttttactgataagaaactatgtgtaaaaataactctgtgatgttaaggtatcttcgtaccagctacacgacatacacgtgcaaaaactcattggaacagcattagaagctgagaatcaggatctgttccagtagggacgtaatgctaagaagaaggggaaaaagttgttgaagtttcttgagactctaagggtacctctaagatagcgttatcctgtggtcaggcttgacagaaacttttctgcgatgattaaatgaggcgatttcttggatttctggggagcaaaaattgaactcaaaatttctgacacgaattctcaaacgattcaagtgagagtgcattgaaatgcgattttttttctgcttttatgctcacctttactcacacttcaaaagaactcttgagtgacccgcccaaacaaaataggcctcgcggagttgtgatgacactcttttttgatggaattttcctcgttgtgatttgtgaccatcttcctcgttcattgttcgttgcctctctgcttagtattttttcgcttcctcacaaaaaaaaaagacagtgcgctactgtagagcatgctttcaaactctggtaatgttgagaagtacacaacaaaaaaaaatcgtaaatctacatggaacgtaatctttaatgattgtcatgtcaaacgatttataactgaacattcaacgataaataatgcaaactgcctcattgcattcaggaatgcttgcaatcttgagtgaaactgaaacatttcacgatcttgtatccaagattcgccaatattgcatgctttcttgcatcttgattgagaaattgcaaacaagaatgctcggtttacacgattgtacgctgaaaaacctgtcgaaaatgaggcatatgggtggattgatggctcggtcattccatgtgcattatttattattgaattttcagcgtgaagtcatgtaaaccgtgcggttttgcttgcattattcttttaaagaatgcgttttgcgtactatttttaagattttgttagcaatgttgggtataatagctaggtttgtaggatttatcattgaataatgcattagtcatggctttacatgattaaagctagaattacgtgacacgtgattctatgatttttttggtgtgtagcgaaatctttggtattcagatcagagttgttcatccatacattatcgtcaacgctgataaaattaacgtctgtttgctctctttgcgttattgcaggaaactgattctcttttcgtgacacatttttgtgctgtaagatgaagaatcactatatcttgcttcatttacaaattgctataaatctgtaatattttatctaatttagcaaagttattagcggaagagaggatgactcatgacaggtcgtattgaagtaacagtgtagatttatcgttatcgtcgttaactttacgataatacgttaactttttccactattttttcgcaaactgaactgttatgttgatgtcgttattgaggccgtaaatttctaaaatttatgttcaagttgatttatcactcggttatcgtttacggaaggttatcgagaaacgttaaattaacgttgaaatttcggacgatactttatcgctcacaaaccctgagtcgaaggaattttctcgggaaccatcaatcatcctgtttaatgttgaatgaaagacttttgaaatcagattttttttactatttcactgaatttagcatagatatgtatattagcctgggacacggttatatgaaaaatttagattctcgctccagtccactttttggattgcatttaggtcccacaccaactgtgcgaaatttcagctcgatcggagaaactatattttagcgccagccgttcaaagtttgtatggggtttactatggcaaaacttacttttgcaaagaaaaatgccagaggtcgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcattactcgttgatatcatatccttgcactttaaaatatcttaaactcattacaagtttgaatgataaccaactcatttgttatttctattaaatcactacatgaaccgcattaatagagggacgggtcaagcttcactggccgtaatttaaatacctcataaattgtctacactgaagctaattgtgttttggtgtcgttatacaggcggaactccacatttcgatgcacaacaactcaagatttctccctatgtcgatgatttctacggttcctccattcgatttccttctacaaatctaaatatcctccttatttcgacatctccatatctcgatgtgttcctattggttcctaagtttctctccgtatctcgatatcaccaatatcgaaggtaactagaccatatttttgtgattccaaacaaatttggatcgcgtaatgacatcagcttgtatactattttatctttttttctgacatcggagcggttttcaatctagtattcattaaagtttcgttctttgtcccgatctctccaaactttgatctcgatatcaagatgtggagagtcgactgtacctcataacattttctcaaattttgaaactctaatagtattgaaagaatgcggacattcgtaaagtgaattgattcatttattaacctgctaacgttaattattcgttaaagacaaacgtgtccgtagacgaggaaatataatttcaaaatgttatttccaaaagtttgtttggggtatcagattcaaataattatcagaagcttccaaaatattaccaggaattcccatgaaaatcttggatattctcagaaattcatagactttggtccgattacgtgattttgcatttgaaagtgacacttcgaaaataaatttcaatgtttgaaaacccagttggcgttggtgcggtatcccaatcctgattttgaaataggatggattaaaaataattctacacctatctaaacaaaagtgctatttgaacaggattatttctgatatccgaactgccacttataagtttatattgaaatcattcatcaaatggaacggccgaacgccgtttgaccgaaattgaaaacaatagtgaactacatttagcgtgtatttataatgaatttcaaagaactgtttattcttaaagaaggacaattcatcattgacatacagctgttaaatgtgagttcaaggaacagtcaatgctgaaagaagaacattctaaatgtaagcaattattcacttctctgctagcagtaatagctgccagcataggttttcgcattgcgtttgtagtcagctcttgtcagttactaaaacgatttacggcttcttcgtctttttgtaccatcgatttgcttcaatccttcttagtacttagtaaattaaataatttatagcaatcacaagtttggcttattcatttcaaaaacggagaaacagttagcttttataaaataagtgttcaccgagtcgtttagtttaatccttaataagactatacaaatgtacaataagccttagttccattaactttgaaaaaatattgaaatatgaaagaacagcctatgaccaaaagaaggaaaaatctcttgtaaaaaaataagcttgtgtaatgtcaaaaaatgttatatcagtacaactataaagaactgccgatgatttaaagaaggtaaaattcccaattgaaatataagctaaattattgccaatagaaattaaaccagtacaagttgaaagaatagcctatgtttaaaagtagaaaaaaatctcatcaaattaacaacaacatttcaaaccctagcaccccgttggaaccccagagacgaaccaaccatgagctcagagtcttgacgcgagttcacaacttcgtcctgaatgtatgaatagtttaatgtgttctcttggagcatttatatagcaacaaacatgatgtcccgcctcatcataaagatcaacaagttaactagcagatcagttatcagtccacacttatgaatcctacgcttcagcgttgaaaaaatttgattatttctttttcttgattcggccaaagggcatacggccaaatgacccattcggccaaatggcattcggccaaacggcgttcggccaaatggccggacaccaaatggaacacacccttaaggacttatcatggattttcaacgaactttctaagggttcttaggagttccaaagctgtacaaaaaagttcaaaataagggatagctgtacgatgtgaaattgcagtttccatattggtgtagagactgtagagtaggtggtaaaacagatagtgatgtattaaattagagactatcaaccaacgcaattctaaaacctaatactgaaagtcaaacaacagtcgtattattattaaaattatttcacattcgttttgcgatcttataagcttatttcttcaaataggtccagaaaacacggaatcaataactcggttattatagaacaaaatcacctgtactttaaccagattgaccgtagaagctctattttcaaaaatgaaaataaaaaaaaaaacagtaacagtatcgccctctgttagctgcattacaacttctaaggactgttcattaaagaaagtggacacctgattgttaacattttggtgtgaaaattccaaggaaaaaattcaaattttgtttcagtatgtactcaagtgtttattttgacagcagaagaaagttgacatcgaacagttgtaaattccaagcgataggtcggtttaacatggcgacacgcagatttattctgcacaaatggtgttcagaaaagctgtcgttccgaggtttggcttaaatcgcgaagtgtccaaattccaatttttcaacactgtatcgaaaacagatgcttatgacgacgtgcaatacatccgaacagaaaaaattgagaaaaaagttttttttatggcaagcaatttgctcctgcggtatgaaaagtactacatttttcacaacgggttcaatcaacggcgaaaattacagaactgaatgcatttaaaaacgtcttctgcccatctaccgaaagtataacaagcctccattgttttggccagggctggcatcggctcactatgtttcagctacttaggagatgtttaagaaggaaaaagtcgaatttgttaaaacatggcagattctaccgaattgcccataactatgccccatttggaaatattgtgcaataatcaaacaacatcttaagaaagatgaaagataagcaagttccatggattttttcaagaaaatgtggtaagcaacacaaagaaaagttaccaagaaagttgtgcagaattcgatgggaggcatcaagagaaaagtcagatcattatccaggaatgctcaataaatgttcaaacttatgtgaatttggtcgagattactttgatttccatatatttcaaaacaacacatgaatttgttcaaaaataaacagtttgctttaaaaaatacgtgtccactttcttaaatgaacagtccttaaccctctaatacccaaccccgcctttagacggggtacactttggaattttgtgtattttttcgtagctcgaaaattaaaatgattttatttttggctcataacacgcatataaaaaaagttttttatgatttttgaaacttttttgtattattgaaaattgtttgaaaaattgcattcttatataacctacaaatgcttgggattcatttaacgtgtattataaaaaaatcgtacattttatatttttctacgatcaacctatcacagaagaagagcctgatggtattgaaatgatttcaaatctgtttttttccgttagttacacggaaaataaaaaatattccggaaaaaaattaaaaaattcatatattcaaaagtatagtaaaaactcaaatttttattattgtcaaaaatcagaaaccagaagaggctttaagaaaaaattgaaaaggatagggatgttcaaaaataaaaataataaaaatcaaaaaccaaatttcataaatttgcgaagacaaataaatcattgcccaaaccgtgtttagaatgattttagataacgaaaaataatatttagatcgaaaacaaaaatttgggtattagagggttaatgctaaaccactgatggcaccaagatgatcaaggttctatataattgtacgcatacagtagcgataactgaataccgtcacacggaataagtgcaaaagcttccagcaaaagttctgaagtaatgattgagttgtagtaattggctaattcttaaaatgataagcgaataatttctcacttagagctataaataacagtgtaatgattgcactttaaatttccagttgtaaagttgcaagtgaacgactttttatgtaaagtttttaacccttatttcatatcgccgtggtacaggacagcagagaaaaggagttttattcatactggaaagctgattttgctacaaatgtggtgttgccatctttcgcaaacatcagttttgattcttttgagtgtccatttttcaatcattttgcttatacaagattcgagaggaaattcgaagcttatcctgggaaatctaagattccggaatttctcagattttcaaacaaactatcattttttgtaaaatttatgtaaaatgtcaactataaacaatatttttacaattaagttaaaaaagaaatcaataaaagtaagagaaataagttataattacattatggaaacatttaaagaatacaactttaaagtaactttgcaaaatacaacagttatcctttttagttacggatatgcagaacaatttgaaaaaaagaaagaaagtgtagcaatcaaatttcaacttgttttagcaaattgtaaaagtcaaaactttgaagaatagaaaaacaatgcttcaagaagattgaattgaatcatactcataattaatattggagggaaccgtattgaataacgttatgtacttccttttcaactaaaccaacaacaacattatttacttaattgaatgtcttctctagaaaataactgtcaaataacaaatctttgctgttttttatattattattgaatctaagatataaaatttaacgattttttttttttgaattttattctcattccgggacgctctacttataatgtcttgaatttaattactgtcaggaacacaaaacgatatttcgcgaaatatgataatatttcgtttgttaactaaaagaccggcgaaatatgttaaatttggcaaaacgaaacgaaattggaaaacataaattttgctttattggattccgtggaacgccgcatatttttgctgatggaatcattcaaaatatcgcataacccttaccattactttaggggagaccgtgaaagcccatccagcgctcaaccagtcgactcggtgaatgtgtgctgctagctgccggttgcgcaagcaaagcgcttagcagccagttagaaagtcaatgacgaaaaagacgctgcgcgctgctgtgccgtgaaaccttgacattggcctagatttgtgcgtgtctctattatggtggaggaactcaaccagtcagtgttagttgtgcggttacctcaacggctcctcactctctctctagtcgaggctcgcaactttgtggagctcccagcgggaatggttcgagcatgactattaattgccgtagagcaactcgtttttcgtgctttcttcgtttgcctctagtagtcaaaccactttgaaatggaaatggctgctaataaactattttctacgattccgttttgatgcgggaatgactgtgaggacgacgaagacgaagaagaggttcgagttgtgcaatgcgcgttggggttccctctggttgatgaggaaggggaaggggagaagcgatacgacggaagtgcttactattacttcacatagacgtgaagcaggtcggttatttcaaatgcggaatgcaattgaatcaagcttctgcactatggggtgttttcctattttttggtctggcagctttaaatgttattttcagtcttatgccgtattgttgagttttgtggtataaatttagtatattgtttccaaatatcgaaaaaaatatgattaattaaaagtagagcgaagaacatttgaacaataattgaaactatggtttgttctcatttgtagttactttaacagccgcttggagacctatactcttggggacttagcgggcaacattacatttttttaatttcaggaagattaaaaaatcgatttttaaattaaaataaattacattcttcttaaaactctaactgtgacaaactctatcatcataattccaaaaggttgtgctctgatatttgaagaatacctcaatagatgttgccaataatcatggaatgatgatcaagacaaacctatcagaacaagtattttttcccattcttgtccacctgatcgcccatagtgttctgcttgcctaagactaagtgagaagggaactaatttgatgagggcacaactatggaagctcccattgcggtgatttgtagtgcattggtcgaccatgtgactactgacggggagctcgtgctgggaagaaagtgaaaactgactgtttactactacgggcggatggctaatatgctaatcatggggtgtagattgatgatagaaattattcaaatgggttttgttagcgaattagaatgttttacaaccgggattgggagaagtggataatttcgcggcacgcgaacgcttgtttcttctgggttgtcgtgggactttctgcagttattattcaagaatatcttctagtaattcctacagaaacttttcctggaaaatctacaacggttttgaggatggaaaaaatttgttcaggaattattccaggggagattaagaacttctctattaattcctgcataaatttgaccaaggattccttccaaatcaagcataattcttcattccgacgtatctgcaaaaataaacaaaccaagatttgttttgcatgggcttgacaaacgcataatctacttattgagcctacaaaagtattcctaaaaccatttttcgattttttgaaataaatttcaattctgccctatgtgcactttactcagtgtttttaatttggctacatacaccctacgtttgcaaagcgactcaactgtcaacactgttcatgctagcacgtacaccgtacatatgctcatagtaaagcgacctatatgcagaatcaaaacataaaatttgaatcagcagatacgtcataccgtttccgaatcactaaacatgttggaaatcgagaaattgggatttctacagctgcagctagctgacgcgtcggcaaactgatgtggaacattcgttcgtattcggttctagtcaatatttcttaccaattttctcacaagaactgttctccatctacttttgttactcacggctccgtccgcgctcctgttagtcgagttgaaattggaaacattcggaaacccaatattcgttgtagttaaaggtagaaactgtcgaatttactaactttattaggttttatgggaatttgcaaaccggtgtatgtgcaacttcaaaataatactggtgtatacgacgtgacgcatgtgaaaaacgaactgtcaaaccgacgcatcaagcaaggtgtatgtatcaatcaaggtatggtatcgacgaatcatcatggtgtatgtgagcggcacaaagcaaaagggtttattcgataatttcaccagtttttcaatccaattcaaaacaaatctgaattgtttaatagtggttagaaacagtgttcttttcttcaacttctacaagacacagcaatagaaaatatgtaaaacattttaaataggatttaaaatgctttacaatatgttgcatcgcatttttctcgatttcatgcaaatgttagatacgccgatttgaagaattatgcttgaaatatttttgtagggatttctccagcgttctggagttttctcatacaattcttggatattattttccatagatttttcaaaagttcattaagtaattttaaaccagagaatgctatagccattatgcaatccgtaattgctattttatttgtgtattaatgacactttacaccataagggtgcattcaagtccttcaaaagggttttcttaaagaaatcctgaaaaactgctttttggattttttcagttattatttgtgccaggttcagaaattgcttcaaagatcctagcataagttatcacctgttatgtctgatgatattcgtagattgaatttttgtagaatgtctaaacaaaaatccagaaggaaatcgttggataagttttgggagggctaaaacttccttgagaaattactggaaggattcttgaacgaatctcttaggaaatctatgtggtagttgtatcaggtattcttaaaccgattagggtgccggtaccaatggttgtaatgtaccagtagattggactatggaataaaacgtacatttttcgattaaaacggcatgtgctatttttggtgtatagatcgcctctagtttagtcgatttgtcaaatttcagctttttattttatcaaaatgtcatataaataattaggtttatgcaaaaaaattgctcccttgcaccaatagtggccatcgtgttccagtagtggatcaacggatggaagcagtttttaaaatggaggtaataaaatgaagaaaagtcccagagatgatctttatgcttcatttgaaagatattagttgctgttccgagaggaaaatgttaaacctatgtaaaaattttccattttgtttaaaattccttgtatcattcccgaacgtctattactggagcactagcacaactactggaacacgtgtaccaatagtggctcaagcgatttcatgttaaaaaataagttttatcattctttttatatttttcccgtatagtagaggttgaaatctttctattgacgccaaaatatctttgttagggcttttcgttattttgttattttgtttttatagcttagatactccactaatggcaccggaccctagtgcctcaatttttgaatgtgttcttaaaaaaaaaacaaatataggaggatcttcttggaagtccgtaaaagaatctcttgaactcttgaaaataaaatcgtaagggtaataccggaatgaaagtttgagcaaatagcagatttacattgaaatttcaggagaaatcatgaagaagccagagcaatacatgacgtagtatcacgaggaatccctaatgaaattctaaggagtaaccaatgagagatatctggccaaattatctaagaaatccgtttttacaatttaggatttttcttgattccttggtctctttctggtttctgttacgtctcaagtaaaatttctaggaaattccatatccaaaatctctcgagaatttactttaaagtctctaatagtcttctttgcaattttccaaaattttcttcgatttttctttaagggctgttttataattccttgttcaaaatctctcgttgtacagcttccgaaattttctttgtttttttttctgcattgtaatctcttattatattaaatctctcgaatttacatctatcattgagattttcttctgaatctcattggcatttgcttcttcggaatcacgttcagatctcttacggaatcggttcagattttcttcgcaaccttattggaaagcgcttcggattattgttgagattttctttggaatctcgtttatatttgcttcggactcttgtggagatttccttcggaatctcgtggagacttccttcggaatctcgtggaaatctttggaatctcttggagagttttccagaatctcgtggagatttctttcggaatctcttggaagtttccttgaaaatctccttaagatttttttttcaatacctgcttgagatttgcatcgaaagactcttgagattttcttacagatctccttgaggttttcttccctatactattgagtttcgaaatctccttgagatttcatttggagtctctttgatattggctttgaaatcttcttcagatttttgtaagattttaagatttatttcgaaaatttcatgatatttggttcaaaatctcaacaagatttaatttaacatctgcacgagatttccttcgaaaactcctcgagattttcttcgaaacctccacgagaattccatcgaaatctccttgagatttctttccaaatctccacgagattccctttgaaatcttcacgagattttcttcgaaatctccaagatattttcttctaaatctcctcgagatttccttcgaaatctccacgagatttccttcgaaatctccacgatatttcctccgaaatctccacgatatttcctccgaaatctccacgagatttccttcgaaattgccacgagatttgctccgaaatcttcacgagatttccttcgaaatctccacgggatttccttcgaaatctcgttgagattttcatcggaatctccacgatatttccttcgaaatctccacgagatttccctcgaaatttccacgagatttctctcgaaatatccacaagatttctctcgaaatctccacaagatttccttcgaaatctccatgaaattttcatcgaaatctccatgaaattttcatcgaaatctccacgaaatttcctccaaaatctccacgagatttcctccgaaatctccacgagatttccctcgaaatgtccacgagatttctctcgaaatatccacgagatttcctccaaaatctccatgagatttcctccgaaatctcaacgagatttccttcgaaatctccacgagatttcctccgaaatctccacgatatttccttcgaaatttccatgagatttcattcgaaattttcacgagatttctttcgaaattttcacgagatttctttcgaaatcttcacgagattcctctgaaatctccacgagatttccttcgaaatctccacgagatttccctcgaaatgtccacgagatttctctcgaaatatccacgagatttccttccaaatctccacgagatttccttcgaaatctctaggagatttccctcgaaatctccacgagatttctctcgaaatatccacaagatttctctcgaaatctccacaagatttccttcgaaatctccatgaaattttcatcgaaatctccacgaaatttccttcttaatctccacgaaatttcctccaaaatctccacgagatttcctccgaaatctccacgagattttcttcgaaatctccacgagatttccctcgaaatgtccacgagattttcttcgaaatctccacgagatttccttcgaaatctccatgagatttcctccgaaatctccacgagattttcttcgaaatctgcacgagatttcctttgaaatatccacgagattttcatcaaaatctctacgagtttccatcaaaatctccacgagatttctttctaaatctccacgagatttcactcgaaatctccacgagatttcactcgaaatctccacaagatttcctttgaaatctccacgtgatttccgtcgaatttttcatgagatttctttaaaaatctccacgagattttcctcgaaaactccacgagattgcactcgaaatctttacgatgtttccctcgaaatctccgcgagatttccttcaaaatctccgcgagaattccttcaaaatcaccacaagatttccctcgaaatctccacgagaattccatcgaaatttccatgagatttccttcgaaatcttcacgagattttcttcaaaatctccacgatattttcatcgaaatgtccatcagatttccttcgaaatctccacgagatttccttcgaactctccacgagatttccttcgaaatctcctctagatttccttcgaaatctccacaagatttcctccaaaatctccacgagatttgcttcgaaatcttaaagaaatttgtctagtaatctccacgagattttccgaaagattttctcgaaatcttcacgagatttccttgaaatctccatgagatttccctcgaaacgttcacgagatttccttcgaaatctccacgaaattgcctttaaaagctccacgaggtaatttagaagaatagaaagcactctcattgagaaattagattggtatggagttcgttgaagtgttttcggaaaaattctaacgattcaggtcactgatttcgcctatgaacattcatgttggaataactgtaactcaggtccgaaataacggtcctccaaagtgaacttcgcttcaacttcattaccgccgaaattacactcggcaaacataagccagaacccgtaacgtgtgcaatgattgaaaccggacaaccatgggagaatttgtactgctttcccatacataatctacatccgggtggagttggtggggtccaattcgcaactcagacctcaactgctttgctagaatcgctttctgatctggtctgttgcataagtcgtcatgtcagcaagcacccttccacttttttactaaaggaaggtatcttcgcacgtagtcctgagtcagggcagactgctgaactcaaagggccacaaaccaaaccgaaacgacgaagacgagaaagcgtttcattctcgttaaccatcactttcttgagcgtaggttcccaaactgtgggtcgcaaaaaatcttgattcgtatattttgcctacgttttcgaatgtttctaaccaaatttgcaattgttttactatagctaccaacagttctacaattagtttctgctttaacaaaaagcttcaaatcttcatcgataaactaatacaaaaaaatcaatcaaaatcagtttcaactatttaatactcgagggattttcataaagcttgttgggagatatcagaaataacattatagagattctcaattttatagatataaaaaaaactctaagaatttttgtcatattcagaaattttctgcttgaaattcaacttcatagataaaccatataatatttgaagagtgattgatcattgataaaataatgatttgaattcaataagttttgaactaactataaattgcaaattattgaatgaatttacgaaaagaaaacaaattttttggttagctgaagtatttttcgaaaaaaaattgtcgataataaaaaaaaacttgtattatttctaacttttttttaaactattttaaaagtatttaaaaaaaaccattaaccataaccatattcttaaaaagaaactttactatttttctctggtgggtcgtgaatccaaaaagattgggaacctatgttctagagccctacgcccgtgtagtccaatatccattgtctttcgttctgcatcggcgtgtgtaatcttccccttgatcccccattcccctctccgatgaggatcagacacatccgcgatgccatggaggacgcactgttccgtgtttttcgcagaaaaacccaagagaaactttcttttttcttacattttgtgtcatgcattctcctgccacttcctgtcccagtcggtcggtgtgtctgctttgggcctggcatccatcctactgccctccgtcatggatcccaaactggagcacctaccagtggcgcacgttctgacaaaggagagtgcataccgtcgtcgtctttctcttatgaatgccgccaaagaagtcaaccgtgatcggtgaagggggaagggggagctccagcaattcgtcagaacatttttctttaatgctacacttttagtagactatgcttggagtgcttcaacgatattacttctgcctcagttcatggttcgcaatctgggttgattttctcagattcggtggtcaaaaattgaaaatcattcatttgaaaacacaaataagagcaaatttaacagaatttaaggaaatttggaaaattggaaaataattgggctggcaaaatgaacaaactcttggacaagaggaagagaatggaaatggaggtgcaatccatggaatgggaattaaaagatacgaaaagattcaaaaagaaattacttatggtacagaataaagaaacaaaaagaaaaaaaatgacttatttttaaaataaaaaaatgaaaaacaaataacttaacaaacaaacaatttgaaaatcaaattataaaaaaaataatttgaaaatcaagtaatttgaaaactaaaagatttgaaaaaaaaattaaaatcaacaaatgttgcaaaatcaaatgaattgaaaatcaagtactttaaaaaatgatctgtttgaaaaatcaaattatttgaaaatcaaaaagaattgtaaatgaaaaagaattgtaaacaaaataattgtaaaatcaaatagtttgagttccaatttggagaatgaaataatttataaaatgaacaatctgaaataaattaatttgaaaacattttttttttaaacttcttttgaaatcgaaatgatttgagaatttaaaattcgaatagctttaaaatcaaatgatttgaaaaccaaataatttgaaattaaaattatcaaataatgaaccagtaaaatagtagactgcacacaacagctcgacagttctcacccactgttcatcggtgccgaaaaaaaacccgaagcataaaatttaatgaattgacgccgttccacatcactcgacaactgggccacacggcagcgacatcaccgtcgccgccgccgtcatgggatccattcgagtcgctttcacaggaaaagcctgccacatggattccctgaagaacgattctgctccggacattaaaaacttatgtgcggtggatttgaggcagcttcgaaattaatcgaaaggctccaaaattgaattaatataagaaagcgagcgtcatcccgtccagtgctgttgaatctgggatgccggccggggaataatcgtccaaatggaaacgaacgaagcataatgattatgcacttgcttctggctcttggcagaaccaaaagaattgtaatgactgactgactaactaactgaacgtggcagctctgcctgaccgactgggggtgtgataattattgcaggggattccgttttttcttgttcttgcctgcagtagtggaactattcacggtaaaatgcattttgcaatatgcactgcagttgggcgattttatggcgctaactcagtccgggtaaaggtgcacccacttcaagtgaaatactaagcaaaggggcgctgttagcataggatggaagtcgtgcgattgttgaagatgaaattcaaatatttgtagtagggaaaacttccggatcgctttatgaatattatatttcattaaaaccataactgccgcataattaatcggattgtaatactacagccttgaatgaagtcgccttccttcaataatgatgccggaagcacttgaactatggtttatgatagttgataatcattatttcttaaaatattcaacatttctatttgacattgaatctaatattcagttttttcttctcttttttcgttgcaggtacattgagatgctgatttaagtaagaatgatcttaagaaattgatatgttataatgttcttcaaaaaatgtaatactttccaacttgaggaacaatttcaatgcatttttgtcttaggtgatttattgaggttttattacggctgcatttaatcctgagagagagaggagacagctggcttagatcgggagctcctaaaatccactggaacctgtcaccaactgtcactggaaaaccgcacattgaaagggcagaggaattcaggaaaatatgaataaaatttccaggtgtttttcgattatttcacatattaaaaaattgaatacctaaatatagttgagtgtaggcaaacaactattgtttttttctatgcatattcttttttcatagtaagcatcatgtgagagttaataatgctctgaatagtgccgaaaactcttgaacatgttgaaaaccatatgatgaataatattgcattataagtaattaaaacaacgcttttgatttttggaagttttaagtttaaggcagagctttctgtaataaccgattttataccaataacttgcggatgaagaacagtctcgcgtaacaagtctaaagggccaatgatcaatttgtaaacaaattggggtttgatacaattcgatagcatctcctaacatccacaaactatgcaaacatcttcaacataatcataaaactaaccgctatgaatccaaaaaataacgggcacgaatcgcgtattttatacaaataattcagtgggctcctgcttaaaacgaccaataattggatctccatcatgagggcctacaatcggaaaattttgcaaactgtcatttgccttagcacggagagaggctaatgactctcttttgctcattcgttgcaaaccttgggccaaggcacgctaacaaaattcgttttggcttttaaaaaaggcccatgctccaaccaggccgaaaatgggcaaagcatttgaactcatcattttttgcagatttttggcagttttcagaacaaaatcgaggaataacatgtaatattgataaatcattactcaacgttattgctcgtcacattgattgatttgaaaacttagaaatagaaaacgtggtgaacaatattcacatcgaattttctcagaatcaacgatctgagaagtggaaaaaccaaacaagaagaacccatacatgtccgtgtattccacttaccgactcttatgcacatttcttctcacttccttttacacgccttttgaaacatcagacagtgggcaagcagtagtatgtgtgtgaaagtaatgtactcacatatttacacaattagtttgccactcacacacctacataattgtaccgccaaactgccaataaatgaaagctcgacactttagaatgacagcttcagcgagacgtttcagtgtgaatgcactctaaaatattttcaagcacgacatgtttaataacactctaatggtgcatcgatgatataatgatataatacataattgtccattcacatcattggtactgcattctcccctttctcgactgtaaaaaattcaaaatccattcaatatcaaaatccaatccaatcagaatcccatccaaattcaatcaaactacagctatctaaatccaatcccaatctatttcaagtccaatccaaatccaatcaaaacccattcaaaatctaatccttattaaatctattcccaaatcacatccaattacaatatccaagtcatgtccaaatccaaacaaaatccaatccgaatccaaaccaattccaaactaaatccaatccagatacgaatcaaatccaatccaaattcaatccaaaccttattaaaaactaatccaaatccaatacaaattcaatccaaatcttatataaatccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccaaattttccagtgatgtactgcctccgggccgagcagaacaagatattcgtcaagtgacaaattgccggcttttttcaatgggcacaagacttaacattctcagaccatcagattcgtaaggtataaatacaacatatatacctgtcgaacagctcaacgcggtttccaagcctttttcatacggaagaaagagcgagtagcttcgatctaactagaccataatgacaaatctgataaaaaagagggtcatacgtgaagtaatataaaaattgctagttttttttagaaattttcatatattttaaagtgaaaattttttttttcaaagttttctatttttttcctattttttctgaaaagttaagctttcattccataaaaaagattggaaatcggttgagctgttcaaaagttatgattttttttaaacattacaaatctaatgcgctgagatctacagcgtgtgccgatgaaaaatgactgattttttattttcaaaaaaatatatctcaaaaactaaaaaacatacatcgctgaaaatttgacagtttacgtaaaattttctgaacttttaagaaaaaatgagagagcagcaatagtccctttggtcccgaggccttcaaaacacaaaaaacggaaacattgagttttttcatgtaaaaaacacaatttttgtgaaattttatatttttcccgaaaagtcaaaatctttagccttcatttcgtccaaaaagattgaaaatcggtcaaacggttcaaaagttataatttttttagaaataaaaattatgcaaaatcgcgatttttttggtcaccctatttcggaaatggtcaccctaatcaaaaaatccaaaaatacgtgtatccttatttcggataagtaacaaaatagcaaatttgtacggaattcggagacccactagatcggtttttcatggaatggctgaaatattatattgtaaccttctgtactggcagaggattcaaaataaatattagctcatctatgttgtacagttttatacaagagcaagttaaggcggagtaggccgtcattggaaattctacgcatcgttaatgattgttgctaactcatcacacaggttcgaattagtgaaaatcagttggttatgtactgacattgctgaaaaagtatccgcatactttcggcatgtgagcgcatctaatgatacattttcggttcaatatgaactatgaggactgagttttattactttgaaattgcgagttgtaattctatcatggctgccaaactgaatgaaggactacttagccttaaccctacccaccgcattattaagtagtattatacatagacatagttttaacaacctcatgttttgtgggcttttcagagcttaatacatttttgtcaaaaatgtatcgaagttgttaactttaaccagttttaaaatgaggtttaattatatggtgataacactgaatattagtttgtaataacatcaacagagtttgctgcagggctggtagcagatcttgtttaagagacttggtcttttttaatgcaaagggactttattttgacggaaggactctaaagcctgtgttttaacaaaaaaggtctgtaaagtatctttttcccctattctgtttgcaatgaatcctgctgccaaatctaaaaggtccttgaggaaaacttcaaagacgcttctatttcacaggttcttcagaaatatttcaggggctccttcggagattcctcttcagattcttttaccaattgtcgaaggaaatcttctagctgtgtttcaagagatgcgtagaggaattacttcagaatttgctacagtaaatccttgaacactctgatgattcagttccacaaggattatggggaaagttattctcagtaatacctccagatatttattgactaaccgttccatgccccagttgttactctaagagattttgcaaatattctttctgaactttttcccataaaatccaggaaggttcacttcagaaattttgaagaattttgtttagggattttcccgggaagatctacaagaatttttatgccagtttctccagttatccttcctggcattttcgtatgaatgctttcaataactcatccacattcaccaaggaattgctgttgtttaatcaaggtttaattctgcagttcttccaaacaattgctcgagaagtttctgagtgaagtcttattggatatttcgaaaatttatttaagatttcacatgaaataatacttctgtaatcattctgatgaattcatttgatagttttcaaggaattcctaaaggatagcagttagcgatttgtttaggaaattgctgagtttttttcttattccactttgtgtttataccaattatgcgcatgctgttcaaattctcacatgaacctctcagcaaaaaaatattgagtttgcatcacatcgaatcataaatagccgtttgagtgaaatttcatgccagcaaacgtagcagacataagaaataattaatattctgcttagatttatcagcaactttggaaaaaactgctccgccgactgaggtttttaataacagtttacgttgaacacaatacttttcactttttcagccataaaaacagtgggctgcatttgacgtttcgtgagaggggaatctgggctgcatgtgacgttgatatttttcctcttcgcgagtctctctcaggtataaactaatcgaaatgtcggatgcataaggaaaagtttgcaattaacttagcttgcaaagaccgaaaaatattcccaccaggtattatgttacagttgttagttgaactgtcaaaagccatcgagtcattctgtacaatcatacatttgtttattcaactgatattaattcaacccttaacttttgtgtccctgacctatttttgcaaccattttttcgtgatcttttgattctaatttccagaatttttagtcgtttgctataaagtattgacagagcagcacaacactattcaagttttgtggcctatatgtactaggatgatgtccttctgtttagctgtttagtttcgtagaactcattttgtatcatattataatcagggcgaaaaaccttaaagattggtaagtcgcatgatatggcttgcaatcatcggattgacgtccttttgcagggtcccgaaatcggatctggaatattccggaagtacttgtagatggctctatgttgcatacaattactcaatatgcattgtattatacttctgttgtaaaattttgaagattgatgtgttgcatgatatggtttgtgccgatcaaatattggtcctcaactgatgtcccaggaaccagtaacattgtagttttatttgatacgtgcaaaataattatggaaatgtctcaaataaccttcggacagacaccacggaccatcagaatcattccagaatcgaccatccgactgggcccagtacaaggcacgaaacttgaatagtgttatggtgttgagtcaaaattttattcaaatctgctgaaaattatggaaactagagcaaaatgatcaagaaaatgtatttcgaaaaataaatcggggacgcaaaggttaaaaaatgtatctgtgacaatctgtaggtaatttgaaataactttaattttcatgtcctgcttctatgatcattgatcatatttatgattgattcaaaagtagaatacaattataaaatgataaaaaattgtcaaaaaaatccagtgtgattcgttgttatcggaactgtgataatcttacgttgtatgaataaatctagaactagaaaaaaaaactagcttataagtgtgagtctttcatcttacatctcctagcttattatctgaaaaaaaaatatatatatatatatatatatatatatatatttgaggatctgtttttgaaatgtcaagctggtatgatacgttgttagatctactcatatgatccaaataaatctcttagtattattccagttttaatgttatttcagaaagaagaaaaagatctgagatttctttgggaatattttgctctaaatttacttgaaataatgtaaacgtctattggcagatatcaaaagaattgcaaaacatagaaaggttaagagggccttccttagccaagtggttatagtcggcggctacaaagcaaagccatgctgaaggtttctgggttcgattcccggtcggtccaggatcttttcgttatagaaatttccttgactttcctggacgtagagtataatcgtacctgccacaggatatacgaatgtgaaaatggcaactaaggcaaagaaagctcgcagttaataactgtggaagtgctcataagcacactaatctgagaagcaggctctgtcccagtgagaacattagtgccaagtagacgaagaaaggtgaaaaccttccgagctagaacttctacttagtatctcataaagttgaagactacaacagctctttttcagcatttacgtgatgatgacgctgctgccattccgatattcaacataaacccaaccaatacataatccacattcatcagactctgtcttttgactcgtaactatcgttgttgttcaatctcaaaccgtatttattctggagcaaccgttcacacttccatcaccaaactatgcataaaacacccacactctctgtacatcatgacttgagcataataaatcaaacctctgctggtgctacctgttgcaacagcaacagcacatcatcggctgcatgccattctaggaggtagcaacataaaactatggtcgtaaaattcgcaattagtagacgcattttacgatcgtttcgtcattctcgccagcaaaaacatcgaccaacaatcaacaaacacggttaagaaagaaaccaattctttgagcaacggatcaacaacgcaaaaaaggaaagtttcccatttcctctcagtaaaaaaggcatccgcggctggtaaactatcggttgttgcaattagcagaaggtctcattcgttgcacattgggattatttcagaaaaaaggaaacaaaattctaagggatattctagaaatttcggaaggatatagaaatttttgtatatttttacaaaatcccaaattttgacaaacttatttttcgataaattaattcctctgcgatgaaaatatgaaaaattagcataaataacatattatttgtatttgtttcgttatttttcaagaaacgcttttaattgtcattatagcatatcgaatttgctgttgcaaaaatttacaataattttctgaggaatcctaggaattcttagaacaatcaagaattttccctgaatcctaaaatatagattccttaaaatattggcgaaatttttggaaagacccaggaaaaaatcaggtaattccattgagaaattttaagatggatactgggaagcatttatggaaaaattgctgacagaatatttgtaggatctgttttttttttatttgtttttcgaaaaatcctgaatttattagtgatagagttcttagaataatttatgaaaggatttttgaaaaaaatcgaattatcataggaaaaattggtaaaaaatcataaaaaaaaatcgtggaacaattttctgtgaaatggtcccattgtgcgttgatggttgggaccgccctttattgatctttgttgcattaccgctcgctgtgccacatcgcaccggcacgcataggtcatcgtaattagggatcatttttcgatcaaaattatcgcatgagcatcgaagagatgcagctgtcctatgggcagcagacaatatctgctaggtagtgtgtttgcgaaaagtgatggatcggatcaacctgtcaattgcgcaacgcttagttggatccagtactatgtgtaaccgatccgatgagtgagtagaacaagtgaaattcgctgctaccggtgtttcttgaggttgacctcgatgggaaaagcgatcgacgacaggtgaccgatcaattagtggcgaaccaatgggtggcgcgcgacgaagcatttggtggaaccacgtgccctctcgagccttgtttgacaagtggaaccttgtgacaccaaggtgctaccgaatgcggctactgggtaaagtggcggacaggtcaacaccgatgatgcgtgccgacataattgggcgtaattttggtccatcagtgcatgtgcacgtcagtgtcggtggactcatatgacgctcacagttaatttatgtgggtcaggagtgccactctagagaaacattcttattttgttaatctccttgaaattttcaaaagtgaaatgtgcttaaaagttctgtccaaatcttttcaaaatttcctacaagatctaccagatatgtccatcgaattctctatgcgattttcttctaaatcgaaagatttctatcaaaatcatctcgtccaacaagtcattttcaagttttcttatggaatctcttgaagatttcaattgaattcattttaaggttctctaggattctcgtcaagatttctagtgaaaactattaggaattctcaatgaaatcttttgaagatttcaatggtattcatcttgaggttttcatcgtatttattttttgtaagagattgcattcaacagactatctcaagattcaatttaaagattcgtggcgatttcttttgaaatcccatccagacattcttcaataaaatcttatagacattcgtgaataaaatcttatagattttcttagaaaatacctacacaaaatttccattgcaatctacacgagatttctgtcattagctccttgaaattggcaacaaaatcttatctgtcaaaatctcctgaaaaattttgtcgattttctttgagatttccatcgatatctcttcggaattctctttgaggtttccattacagtctttttgatatttcgaccaaaatttcgaagtgatttacaacgaaatctcttcgaggtttttttttcagatttcgatcgaaatcacctcgaaatttgtatttaaatatgatcatgaattcaatcgagacctattaaaagtgtttcattgaaatatgtagaggtttctatttaaatttgctggaacttcttaaaacatgcggaaactaataaagctttgtgttagattacattttcaaacgttctttagttactaaaagtactattgaatgaaatccatgaaaaaatagttgacactttacaacaaaacatcacatcaaaagcaaaacctcaaaatattagcctaaaaattgacatttaggggtggcgcaagcggcttgaagttgaattttaaagttataaagtatgaccttaagtgaagtgaacataactttgttgtttttaaccaattttgaatgttttggcatcattctcttccaaattaaattcacgaaaactttgtagaacaccaatttttttctaaaataaaaactggtgtaataataaattttcgagtttgttatacctttaaatttagtattataccattttacttcactagagtttgtatcctttgacagatactcgtatttcgacctcaactgtaaggccgtcttcagtgtcaatgacggccttacagttgaggttgaaatacgtgtcgcgtatctgtcattgattacaaattctagtggaattaaatggaataattcttaattcggtttttcattaatatagatactttaagttaaaagtagttttctcgatttttttccgcatttcactaaacaaaaacatctttgttggaccataactccataaatactacaccgattccaaatctttttacatgcctttgaagctattttagttgttttcaaactgtgcatgcaacacatttgactaaaaatggttttgaccaagttttttaacaaaaactgcgcaaaaacctgtttttctataccgaaaaatgcattttttttttaaatattgctgcatttgttaataaaatatgtgcactatacaacatgaatttttataaagatgctttggaaactttagttttatagtaaaaaacaaatagaataatccaaataatccgttactccaaaatttgcctcaagaaacttttgtcagacctgccgaaagtacatagaaactccatgaaattgttattttgcccttttctagaaacattgtcgaagatacttttggtggagtgactggattctgattgaaactgtggtagctattgcaatcaagaaaaagtttcaaaagaaactaaataacagaagttcatggacatcgaaaacatgattgcagggtttgagcatatgtccacgaagcagtttttaatacataaatgttcattaatcaagcctattttatttcatttgttattgtcctctttgaatttcagagtgaattttgaaaaatagaaccttcatttttgagttcttcaatctttcaaataaagaagtgaaaaaataagatttttatacaaaataatcatgtttagaggcatgtaattctgtgtataatgatccgaacaatatgaaatttaggaaaaaactaagaataacgtgagtttaccatttttattcgatttttaaatttttatacatctgtctaaaagtagtaatttaaatttgtagattcttctataattggagaaaagacagtagtaaaccgggtcttttggtttaaaaacaaaaaagttatgcatagggaaactaaaatgctgttttttacaggttgaaacgggccattcccttgagttatttttaatttaaaaaatctaaataaaaaatgccgataaaacttaattactactcaaaacgtttatgtattttgatcgattttataaggcatgttacatgaattacgtaacgctaaatatcgaaacttttgcccctctttcccctgagtacgaataagtaacattttttcgaactcccccctctaattatgtaagtgtcagacaagaccccccttagttttcaaaattatatataattttttaggttaagcattttcttcactatgtaaattggatgttttcaatcgtgaatgtttggtacgtaacggtaaccggaacccctcccccctaatgtaacaataagtaacggaagctcaacccttctctccccttcatgcgttacgtaatttgtgtacgatgcctaacacaaatgtttttcgaaaataaacgtttcagtattgtaaggtgaatttttagattatgtttcagtaactaaaagtataactatttgaaaagaagcaagcaaagcaaagaagtgtaagtaacaagtgaagttcatgctttataacagtttctttttaaattaatcagttaatcagtatggacctgtgttttggctccatatgctttgtatggagtgtaaacatacttactaaattctttttcgttattagaaacgttttgtttctaaattcctcattcatgtttagaaactaatatgttatacattgtaattcaatgtacagtgggcaaaaatgacacaagatctcctgaattaacacttttaaaatcctagattgacaataaattcaagaggaatgattcaactaggatagaagcaccggttggccatacgtcagtcgtagccatagtcgatcataaaccgttttacatatccacatacatacattcacatcatagagctacattcatttactcgcccaaaataattcaaaacagaagaaaaataattcatttttcttataatttcaactcccatacacctaatctggctagggtactcctaatttggtcactctcataagaaatcaatgtgattggcaaatcgagggaccaatgcttaatctctggccgaaactggttctggtggcctatattgaccaacgtgattttcaaagcaaaacacggtttcagctcagttccgatatttttcctacataatataaatctaaagcttgcgtttcacatatttgtagttcaaatagggcttcccatatattgtctttttctcttaggctggccaaaacggatggttctaccctactgctttctttcaaattttgtcaaatagagcatcattattataacttcattgttgagagtcacagccggtggctggttcgtcccccaatataatcatgagagatttgtttcgaaggaattccgattttcaatacaaattacaattttgcaattcttttaaaagcagcaccagtgaactaaccaaaacaactctgcttcttcggcttctgcttcaggcaagacatcagaattgcatagctactcaaaactcttataactcatcggcgtcgtcgtcgtcgtcgtcttaacaaattacgtatccattacgcgaaatgtggggacggacggcagcaacagcacaacatcgtcatccgtcaaacaacatgggcatcgccgaattgggcgacaaatggttggatgcaacccgtacccgaaggtacttctcggaaggacccctcgatttcgggttttcgtttcatctgatatcgattaggacgcatgggggtcttgtttagactagtggtccgcggctgcgaagtgtagggttcgattctcggtcggtccgaaaaaaacctggacatccctgggcatatagtatcatcgtacatgccacacgaaatacgaatgcaaaaatggctactttggcaaagaaagctctcagtaaataacagtggaagtgctcataaaacattagggcgagaaacaggctcttcccccgttgggacaaaatgtcaagaaacagaagtgggggtttgaacttaaatttgttgacgatgctctgtgactatgctgatggtaattttcagttgccgaccgaatctcggatttctttgaagcgcgcggtagaagtaaaaggttcaaacatgacctaattttgcagcgcgtgatcgacatgggtgggtcaaaatgaccgattgcgagatgtgaagccatacaacactgttgtttcactagtttgggtagcttatttgcaaagcatgtatgacagggacgttgcagcttccgatcacgatcgatcaaaaaacaatcaagtgatggagcatacaaattgtaggatagtgatattaacccctctaccggcagcttcatttttaccgctaaattcaaattcaaatcgttataacttttttgtttttcaatatttttgcaccattttctcacaagctttcaaaaagctcttctagttttaggatctgtgtcaacattgatcattggtcacctggttttgaagatattcaaaaatccgtaactagaaccccccgttaatttctcaggcttcagaattttattcgtattcggatattcactcttcggaacaatacattgatgagagtatgttgtgaaaaaatgaagcactttggtgcagccgtctttaagtaatgaccatttaggtttctgtaaccacgctggtcaaataaagatcttaaaaacttcaaaaaacatcatatcgtactgaaccgatttgtatgatttttcagagaagctccttattacctggtattatatagcccacattttagtttttgcataaacttatcaaaaccaaaatggccgccaaagacaatttatatggaaaatgtcgatcccgcaaggaacatcgaaatatctttaaaaccagatcaccaatatttcatatcgacacggattcctaaactagaagagttttttgagaacttgtgaaaaaatggtgcaaaaatattgaaaaacaaaaaagttataacgatttgaatatttattttgcggtaaaaaatgaagctgccggtagaggggttaaacaaagaaccaccatgcttgggttcaagcttgatttacgatcttcaatgtacactgtaaaaaaacctctatcaaatcggtgctcactaatcattttctatggctaacctgcacgtctggacaaaatcaaataaaaatttaaggcccgtttcaaattacgcccttttgattgtataaggccaaaaactcaaaggaatgtagaaatatttacacggattttcattgacagtgattattaaacgacatttatcatccatacttggttaaaagtaggtttgtttagttatttgtaacctctcgggggagttttgaataaaaagatgaacaaaattttgaattacaccctttttacagtgtaaccattaacccctctaccggcaacttcattgtttaccgtcaaacaaatattcaagtcgcgataacttttttgtttgtcaatatctttgcacctgtttttcttgtagtttaagaatccgtgtcgatattgatcattggtaatctggttttgaagatattccgatttttcttgggggaccgacattttccatataaaatgtctttggcggccattttgttttacgtcattttatcaaaaaaataaaatgtggaatatataataccagttaataaggagctgctccgaaaaaatcatttaaatcggtttagtattattggagttatcaaaatattctaatattgtgtttttttatgttttcaagatctttatttggccagagtggttccagacacataaatgctcattactcataaacggctgcaccaaattgcttcattttttcacaacatactctcatttatatactgtttcgattagtgaatatccgaatacgataaaaattctgtagcctgagatattaacgtgtgttatggctacgcgtcggtcccccaaggaatttcggaatgtctccggatccagacgatcaatatcgacacagattctaaaactataagaggtttttgagagcttgtgaaaaactggtgcaaaaatatcgagaaacaaaaaagttttcgcgatttgaatgttttgttcacggtaaaaaatgaagctgccggtagaggggtaatcataaattttgaacagattaattagatattctgattccgttaatcgtgtttaaatgtttgcaaagacaagccgcaaatacaaccatttgaagttttccaaaaatatctgattttctataggctcaagtgctataagccattacggagccaatttcatcattcgaacattttcttttgtggcacagttcagggtagtttgaagaagccatatactcgcgtttaaatacatttcacatacagctcatggttatattttgtatgaaaaagcgctagtatacctcatgaaatactatcgtacatttagatttcagtagtgggcagttatttgttttactttattcagttcttacttcccggatttattttttttgatcgagtactactagttgaatcaaattttgttaaacattccgtataagtagtgtatgaaacaaatagaaattaacgacattgacaacagtggtaagaaatggaagaaagtagtaaaaagtagtgtttaaagtaaattttaagagaagggctaatatttcaaattaggtttaaaaaataaaaacgcgtcatttaataactagcaacccgtagaagaatttcaacttcaatataggcaaacataatccgttttctctacttttgcctttcttggttggtgaagagtcttcgataggccacctaaccagggttgcgctacctacatcgtgctagaggggctgcctcctcggtgctgacacgattcagcaatatccgtttgttctttacatggtgaccacggtcatagccatcacaactatccacctttatcagggctttggacctgtagctctggttctcaatagtttcaagttctttcggccatgctactatggtgagccgtcatgcgctagcggtgtaggtataggcaaacataatgaaaattggagtattttcaattatatagcctaacaaaacttgtgtagttcctgcagtagatatttttttgtttgcgtttaccatttatagcgacttgtgtgtccaaaccaaatcaaaacttgacacaaaaagaaaacatacaaagaattctccaagtcgctaattatttaaatcactttagaccagcataatagcgaactatgtcacagaacatttaaagattttccaggaaacaaaactgaacgaacgttacaaaatctatgtacattagggtgcggcatattttacgaaaaatctcaaaaccaaaaattcagagcacacgaatctgaattcaaatcacataaaagatctcaaacttgaagccaaaaatattaagatttagaggtggcggtgacttaaagatgagttttcaagttatgaaatacgatctgcagtgaagtcgtcattattttgttattttccaaccaattttaaagcttttggcatcattcttttcaaaattatttttatgaaaagtttcaagaatgtctaatttgtctaaaatcaaaactagtcttaactagtttttaacaattttctcaaaaaaattcctcttttgattaaaaaataatttttatttgaccataacttcatgaatattgaaccgattctaaatctttaacatggttttgtagtaattttagtaggttttaaattgaaattaattcaaaaattatattacatgaattttcaaaagaaaatattatatttttcatttttttgtcagtttatcgtttaaacttaagctgaaactgggtttattatttgttaaacctttgaaaaaactcttagggccgatttcttcacccccgcttaggccaagatgttataacttcaagtaaaaaaacttttgttacatagtaaaaatgtaatttaagatatattttgatgttaaaacattcaaaaagattcaaaatgttcaagttatcaaaatttcatatatggccaaatagggaaccactttggccataactggtactatataaaatcgtggtttgtaagagggacggttttgaattcttgaaaaccaaataataacgaatattccttgcattacataagtatatttgccattgttactttttcttagtttagttttcgctatctgtttatactaaaatcacattaaattgtaatgttctttagaggtagactcgattaataagaacaccattgaatagaatgattcagcaaaaaagacagatgacagcacacaatcataagctaattttgaaagtattgtttgaagtaatttttagaaagtgcttaatgtgaatgctcgagttcacctagttattcacaaaaataattccttgaataatatgatataattggctccgtaatctgttacacaacttgagcctgaacaaatgaataaatttagtaaaatttttgcggtgtgctattggcaacctccggttgaggcaagccgttgaaaaccaatgcaatttaggttctttagggcgcgaagaggggatgacgaaaattgatgtccgatgccattttggaatccaagatggtgacctctgtttggggaaaatcgttggaacatagaggatgacgaaaatcgatattcgatgccattttgtaatccactatggcggcctccggttcggaaaaatcgttggaaacctatacaatatggatattttcggaacgtgcgcgacaaggagatgacaaaaacgatatcccacgccagtttgaaatccaagatggcgacctccggctgagtgaaaccgttgaaaactcatgcaatatgggtattttcggaacgagcgagaagaggggatgacgaaaatggatgtcattttggaatctaacatggcgacctccggttggacaaaatccttgaaaaccagtgcaatataagtattctcggaacgggcatgagaagtgtatggcaaaaatcgatgttcagtttgaaatccaatacactgaaacctcaactaatgaattcattttttttacgcaaattcaatggacgtcacattttacgaagtaaattcaagaacatcagttaagatcagtacattgatccatttgcttatatgaagagtttagattttatgccataactaagtatcaacaacatacaattacagtcgaccttaaatcacttattacgcttgtagctaccaaggcctatattcaatggagtccttgaagtcctcgataactcaaatgaatggttgagagactgtgttatattaaaaaaaaactatagaccattaatcaagcttgtagatcccaaggtctatactcgatgaagttcttggaggacctacaacatcggtacatcttataaatatacttattttactgctatgaataaataagggctcgcgctataacacataaacttcaaaggatagtcaaatgtactgtactggcgtcattgaagttatatattccagaaagtttttgaatgaactaaaacatctgttgtactcacttagttaacaaaactcggatctaccaaagcaaacgattcttcaaaatataacaatcttctagggtctagtattgtaagatattcttctacatagaaatgataaattgatctccattaacttatgtagaattatgtgccaaaactccataaagtttttggaaaattctagcctgattaagaaccaaatatatcaataatatgtcaatgatactgaaagagcataatttctctaaatcaagtggactccaaatagcaaaacctcgttttacgaactaagctccctcgttttacgcaccccgatctagttcgtaaattgaaattacagtgtatttaattgctctagatctagaatttgtatcctttgacagatgcgagtgtttcgacctcaactgtgaggccgtcttcagtgtcgtgtctagacagtgaagacggcctttcagttgaggttgaaatacgcgtatctatcaaatgttacaaattatactggaattaaatggtatagtattaaattcaaatttcatttacttagaactgatgctgtttgacggcattatcagcgatgacgcaaagggatagaggaacataaaacatgagatagggacagatctcgatatgagatgggaacccacgacctcctgcttgggaagcagaagcgatagccatttgaccacctaccccgaagaaaccgttgctgttatttcaactccactgattactaaacatgtcttctcagattctaatcccaaatttctttcctttttatctccatttccagctgttcgcgccgatcggatgcgtggcgggaggaacaaattcgggcccatgtacaaacgcgatcgggcgcgaaagcttcaaatcatgcgacaacgacagttggccatccaggccttgcgggggtcgatcggtggcggcgtcggtatcgggcagctcgggtcggacggtgcctcggcgcaactgcagggcatcgactaccaccagccgtactccaacatgcacatcaagcaggaaatccaaataccccaggtttgttgtcgatgatgggcttgctgggtgctggacctttcggcaagaggtccggctcgcagcatccaatcgatcgaaactgatcgcagtttcctgtttcctaagaagctacgttttaatcgatgtttcctatttctcttcttatttttcatcaccacctacgccgttcggtgtttggcaattccgcaacgtttctaccgcccgggtctgtgtgtatttctcattccttgaacaattcaggtgtcttcgttgacgtcctcgcccgatagctcacctagtccgatcgccatcgcgttaggtcaagtgaacccgcagacgacgatatcgctgagcagtggcgtcggaggtaatggcagcagtggaggcggaagcggtggaggtggcagcaacaacagttccggtgcgggcaccggaggttcaaactctacgtctacggctatccagaaccagctatcggagtccaaactatggatgagcgctaactcgacgaccgcctcgccacattcgctaagtcccaaagcgttcagcttcgacagtggaacgaatcccaccagtacggccgactcgggcaacccagcggacaccttaaggctagtctttacagttatttcacttttgcactaccctgctagaccgttccgaagatctcattgccctcatgaagtctgcaccatcggcctcgggctgcatttaatagttgttttctctattctctattttttcttctttcgctcattcaaaatcatctcaactacgcccccctccttccccctcgtctcgtctcggccacccggaaattcgaaaaatctttcggaaaccgcgccatcctacactgtcatcgcttgtctttttctttccaaacaaaaaattcataacctttcatcctacgatcgaaaaccaaaaaaaaaatcaaaattgtgaccttgaacccctctaccccatttctattgtctatggcttccgttcggttcgaccatatctagggtatcgccgatgattcgcgacttcgtacaatcgatcgacgaccgggagtggcagacgtcgctgttctcgctgctgcagagccagtcctacaatcagtgtgaggtggatctcttcgagctgatgtgcaaagtattagaccaaaatctgttctcccaggtggactgggcgcggaacacgatattctttaaggatttgaaggtaagtggtgtgtttttttgctcttatatttgtattgaaattgagattattagaaggcatttgttgcgaccagaaaatatagtaggtgcagagctaattggccacttccatgattcactttggcatggggggttttctcggccaaattgtctgaaaccttgcaataagaagcacttccttagccgagtggttagagtccgcgactacaaagcaaagccatgctgaaggtgtctgggttcgattcccggtcggtccagaatcttttcgtaatggaaatttccttgactccccttgggcatagagtatcatcgtacctgctacatgatatacgaatgcgaaaatggcaactatggcaaagaaagctctcagttaataactgtggaagtgctcataagaacactaagctgagaagcaggctctgtcccagtgaggacgttaatgccaagaagaagaagcacttcaatatgacgcacattgtgggtagatataagccctggagtataaaaaaccccactgccggagattatgcctttggaaattgctttcgtaagcttaagaactttcatgtgcattggggtaatttttgccaatcggcacggcaaagaagctgtaacttagtagaggaaatagatataaatcttagattatctgacttttcttaacttctaaaaacgaacatttttgagcttccagtgtcctctagaagcggtgctacaaaaaatatatatgacacattatgcattaagggtaaaaaattaccgagatatggaactctagaatggaactccagacagttttttgtgagtatggtcattctgggcacaagtgcacctggaacctatttcagaaagaaccgcgatatagtctgctgctcaggttagtgttccaatgaaaacttatgagaagtaatgttaccagaaaatcctccaagataatctctaccgtaatccctacagcaatttctccagagtttctactagcggttttgccagagatttttcaagaagaagggctctagaaatacattagcgatacgttcagaaattttgccaagagtttcatcaacaataaataatttcatgaattcctatagctaatctttaagagttttcttcaggttttctcccagggattcctgcagaaaaatcgctatatgaattattataaggatttttccaggtaaacctccagggattccccttgaaattcctccagagattcgttctgggcctatagaattcctacagagattcgcctatgaattcctccagggatttcattaaaaagaatagggatttctccagggtttactccgcgattttttttgtaaatattactcctttcttgaaaaagtgtattgagaaatccctgaataagtacctgtagggactctgaagcaatcttcaagaaaatatagagagtaatccctagaggaatcccctgttcaattgctggaagaatccatcgagaaattcttcaggtgcctatggaggaatttccatgtaaacctctggaggaattcctaaagaaatctatggaacaccagatatgctttttggctatgtatgctttatgttttcaattactttttaataataaagatgcgtagacaaaaagcatatttaattaaaatatatatatatatatatatatatatatatatatatatatatatatatatatatatatatatatatatatatatatatatagtcgattctctgccagctcatccctggaacaatttctagagggaaccatgtagtgatttatctagagcaatccttggagaaattcttgaaaaaaaggctgaaagaacctgcagaaatcttggtaaatattctcctagagaaatccctggaggagtctctggaaaaactcatgtaggaatcgctgaaggattttctaagctaattactgaagcaatcttggcggcattcctgaaaaaaaaaaccctgtcaagatttttctggatgaattcctggaacaatcctaggaagaatccatggaaaaaattctagaaaaattccaggagaaatctctggagatattttccaaaaattatttatgcagagattttactggatataaattcatccagaaaaatctctgcataaatattttttgggaaatacctctagagatttctcctgggatttctctagagatatttttctaaggcaatccctggagaaattcgtaggatattttctaatgaaattcctgcaggaatttaattggagaatctctgaagcaatttcaagaggaccaattggaggaatccccggaggacttatggaggccaagaacgattctctggaaaaatttccgaggaatctctggagaaatcattggagtaagtcatgtagtgattttcctagtggtaactctgggaggaattccttgaggaatttgtgagttaaataacaccaggaggaattcctgatggaatacttggatgaattcctggtagtatccctagagcgatccgtggaggaaatcgtctgaaaaaaatcccgaagaaatattcggaacaattcctggacgagtcgcgagaggactacttggggatctttgtgtgtatccgtggagtaatcctcggatgaaattctggagaaatcactagataaatatcttgagtaatcagtgaagaggttgtcctagtgtaactcttggagaaagccttgaaaatatatctgcaagaatctctgtagaaattttcttggaggaatgcttggagaagcagctggaagctttactatcagaatctacagcagaaagaataacaaaagaaatcgcttggaaactccttggagaaatcttcggagaaattttgaaggttttactggaggaatctatgaaggagaatcactggagactttcctgcaggaactcctggcgaaagcctaggaaatcgaatgcaaaagcctatggaatctttttgttattacctacaaaatctcccttacatatgcttggaaatctcgggtgctctttccatgagcatgagcattgatgaccgtacaattcgtagttgctactccgtgaatgaccacaataatcgaaattgcacaagaaatcaacaaacggagcttgggtgtagcttaccatcctcagtgtataatttcgagaattccaaatattgtaaagtcaataacggtgccagctccgttcttacgatcattgggaaagggaaggaatgttagtgtgacatacattgtttctaaagaccgagtatatgtttgcattttcatggttgtcacgggaagaagtttttgtttgtgggaaggattcagaagctacacaatctggattcaccttggtaagtgatgcgattcgtgtaacctcaatttgaaaagttatctacttacgtagtcttcaattcagttcttctaaacaaaaatatgtcgacacctctgaagacgaaccattcaaagagtttgttgcgtttagtaagtgatccgattcattcgttcgaaataatcctctaaaagactgatgaaacatcgacacgttttgtgtctaactattcaacatttttcaatatgaataatgtaatatatacatttcacgatgaacatcattcataagaaataaatgcatgaaacgagctcaccaattgataatccatcgttgccagggcagctccaaattgctccaatttcgtcaccgtcctaccgcagacgggttaattaattaacgagtcggcttgctcggttttcacaaaccactgcccagcaaacctcgcaaaaaaattctccgtggacgcaaaacgtgcgaaaacaaacacaaaatttctacggcgaagcaataacgaactgtcttactcgggctttactaagcatccaggaaatctaggatgctcttgccgtatatttattgagaccccttatgattttccatcgaatttttgtcgttactgatttcgaaaatgctacaatttcttcgaaaatctcacaattagtttcgaaaacttattctgcaatatccactcaagctttttttttattgaataatcattcgcactttcccaggaatttggaccaacatcgaacccagatttttgagtacagctttgctttgaagccgtggacttttcctctaggctgaggaaggtctctttatcgagctatcctctgaaatcaaacctgtgtaatttattcctgaatctttccgaaatgatttttcaaatctgaaaaggctgaaaaaaacctttgttaattgaagcttttagcctactccatgaaatctatatcaataaaaattgaatggtgtttatatgtcaagaaatgactctagaacaggctatcggatttttaaaattcttccataagttcctgaagtggtccgacgtgattatgtatgccattaaaatgcacaggatattgaatgggaaagtcataaaacgggaataaacggaaatgtcatttagcacggcccttttcatggcgttttcaagtagatttgatggcaagacaaagtgtgctgaggccactagtatactgtaaaatcgcttcaaaatctcatattagacatcacacatagactcccttggaattctttagactttcatctttctcgcatatctttcaaaacctgttttaaatttcttatgaaatctacctgtatgtcatgtttttgaaatcttcttaataattatttttcaatctttatttgaccaaattcgtagtttttttcttagaataatctgattttttctaaaaacttcgaacaattaacaaaaaaaaacggttttctgatttttcaatcattttttcaataatgattcctccaaaatctttcgcatatatttttttacagacgaattcctcaataacttaccaaaaaatcgtcgttaaaatcctctgatttttttcctgaattattttcaaatattcttttaatttataaagaaacgggaacaaaattttcgaagaaatcgaagtttaagggaatccgtcattgatttcagaattttcgtttaaaatcaagaaaatttacaggaaaatgtgttcactgtattctattttccaagcgaaacacattgagcacattttcatcgaataatttttaattttgaacagaaaatctgcttttgaagttttgatgatgatgatggttctgatgacggaacgttgaacgttaacttaagcatcttcttcttctttccggtgttacgtctcaacaggtacagaaccttcttcagcttagttctcttatgaacgcttccatgatttttaacggacagctttctttgccaattggtatttccacatgtgtatttcgtgtgacaaagataatctataccctgggaaatcgagaaaactttcaactcgaaaggattttcaatcggcgggattcgaatccatgaccctctcagcagacccgctgcgcgtttactgtcacggctatttggcttcatagtaaagctaagtaaagtaaagaaattccttgactgaatgggtaaagaaatttcctacagagagccttctatgaaatgacatttcttctgcgtactgcgatcagaaaaatgtgattttttggaccaattctaggaagaaatttacctcgcatcgagataggcgattcgttttcttgtcagtagcaaaccaaccttaaaagttgaatatttcagattccataaactctggtgactctaattttgaagtccaggagcctctattatgactcgctagacgccttcatctttaaaactaatcacgaaaattaataaggagcatctagaatttagaagaagaagcccaaaattagctagattcttattcgcaacttcaaaatatgaacatgattcactccatttttaaataaaccattgagaaatcattttcatatgcacaccaataggtacatagtgatctcattactccagaactggaacggatgcacagacgtcttccgtcaccatctcccgtctggtgtcgtcggcggaattcctcatcgcccattcgaacacgtctgatttattaataaaaaaaaattctctcatctgcagaactgtcccaacaattctgcgtatgatttttctaaagatttatctgtctttctccatacttgggtggcacataaatcttcgcaccgatccagacatgcacgccgccgccatatatcaaggtcgctccaataacccatgtcacaatgtcatcgtcgtcttcgtcgcaaaatgcaagtcagttcaagtgcccgaagatgcgtgtctggggtgcgtgcttccctttcctcacacgaatgatgatgatgttgcatcttcggacgtttctttcgcatgattgaaattgatgcatcactagggttattctaattaaaaaaagaaacaatcttccatagttttcttacaatttttacgatgagttctgagaaattttcagtggtgatacaaaaatggcgtaggtttatatggcaatttttatagagaatatttggaatatataccaaacacgacaacacatttcttctttaaaccataatatatgaagttcctgaagagaacaattctattcgaaatatgggataagagataggggtaagcgggacaatatgggccacattcgatttgagcttgaaatattattatatccttgaaacaaattagatcattgacttagctttagacttggagttcttccaacaatgtttgttgtatcattgttggaataattcaaagttatctggcaaatcgtacacttcaggttcacgaagtgtacgatttgacaaaaaactttgaactattccaacaatgtttgttggaaaattaaagttttttttttattttacaatcaagtcttcatgccaaacactgtcgaatgctttttctatgtctataagagcaagagcagtagaaaagccttcagatttgttagaacgaatcaaatttgttacacgtaatagttgatgagtggtcgaatgtccatgtcaaaatccgaactacattggtaaaaattgaattttcgttgatgtgggccatcattctgttccgaattaccttttcaaaaagtttactgatgaaggaaagcaagcttattggacgatagatggaagcttctgcaggattttagtccagttttaaaattggtacagccttagcacttttatatttgacaggaaattattccaactgaaaacatttgttaaatatatcaaccatgagaatgtagaaaattccatcatcaccaggggcttcaatatttttgaatttttaatttgtttgcttttatattgctccattcagtattataatccagtaaacttctgcaaaaatttcaaacaaaattaactcaaaaaaaattcgtttctgtttctgagcactgttctccaattcgaaccaccctaatgcacacgtagtgtcagtgcaatcgtacagacttcttttgaagttcgaacgagctacgaccgggaatgtaagtgtcatcacatgcttgctgtcatcattacttacggttagagtgtcaccgtaaaagatgtacccctcggttgaaggtcgtgcttggagattggatgatcgatcccaattattgccgttgagaatcatcatcatcatgtcacatcacacgggaatcgaaaacgttttactcttttgttctcaggtcaacaacgttctcgaagtttcaaatggaaatgtgggtcagccagaagcagccacaaattggcacttttatttatcccatttctcctgacgacgacactcgacatggtgtatccctcttagctgacgctgggttttgagccgacacataatggcaaacgaagtggtttgaaacagattaaaaagtgtaaacgaggttaaatactgacccggttggattggaatcgatacaattacgtaatggtggggatggtctggttttatcgaatcgaaaatggacgttgtgtccggttgtgtaagtttgagtgaaactgacactggacgtggaaattcctagacaattattaaagctctgattgatgaacaggcttgtatggactaagcctgcatgtcatctgtagtaggttgcaaaaaagtttggattttttttttcatacttgcaaaaatggaagatttttcgtaatgcttctaaaactcaagttataatatttccacataaaccaaaagctctttatttgaaaccctcaagaggaattccaataaattggtcagatgaagtttagtatctagggcccatgctatataaaaatataacttttaaaaatcacatgaatgccctccaagccaaatgtaacaaatatgtgaaatgtctttattcccttattgatagaaaatcaaaactttgtcttaaaaacaagcttttgatattcaaacaaattttcagaccagccatgttgtatgctgtattaatatggactcacggtggtaataccaggatggaggctctgtagcggtttcaagataaaattttgaaaatgattctgaaacttcctccctggtattgtactaatggattacatagaatatacaatgttgaaacgttggaacaaatgtcgaataaaataattaataattttagacaaaaattgttgcaaacttcggttgccacgataaatgcgttacatatctaggttgagttaatcgctgtactgagtacacgcaccatgaaaaagcttgctttacatacacagctcaagcgaggtggtactggcgatgcctgaatgcgtgacttaacgttaaattcgagagctccagaaatccgtcagaaaccaaggtcctagaatcgctgtacattcaaccttatctcttaaaaggatagattgctttacccagaattgactcaaacagttataacggtaatggtattgctgagagtgatctgtttgactcacaaaacggtcgtgaatctttgcgggctcccaaggtccttccttatttccgtgataaggtttgtgacatcaatgcaaagttatgctgaagatttctcgtaacgcgggtaattttaattaacatgtcaataaaaagaattaactcagtaccaacttaggtggccactccagagaacctgacccatgagggcctttttggagacatttgattgagattgagacgttgcacgatatgttttggacataaaaataaatgtcctcaaaagggccctggcggaacctgtaggaagtgccctggagtggcttttctccagaaagttttatgtatgtattttctccataaagttccatatggaaaagttgtagatctagctaaaacctacaactttgctgaaggcagcacagtgtatttttgaagcgaatttactcaatttacagcaattacgttcacacagtttttgcagcaaaagttgaatattgtatagcctttcgaatgccgcttgaaaaaaaaaatcgaaccaacttcatgcgttatgggcatccaaaaattccatagtttttcacttaaattcgcttataacttcaaaatcacaagaattacaaacttgcgatgttcagcaaaaatgtgtatcatcttcctctgcaactcttctgaagaccacattcacgtgaaactgaaaataaaaaagttaggccaaaataactgtttttttttggatccaccctaagttaaaactttcacaatcaatttacttagctcaaatgaatagttagatcaaaagtgtctacgacaaagttgttcgaaatgagtttttctaaaaatttgcagaagagcgcacatcaaacaaaaaaattggagtcaaaatttaaacttaaataagggccaccctattcaacttttttcttagaagatgcaagttcaattacgaataacttctctgaagacatcgaacgtctcaaatcgatgagaacagagaaaacacttttttcctgctaaaatgtcggttcggagcattgtttccaagattctccaaaaacttctaatgatgacactgtggaacacgtttttgtctcatgcatcaaaataccgctatttacttaattaagggatgctgaatccattgccgctttcaaaagtatcatagcacgtctagtttttgagatattggttgttgaaaatgttgaatttgtgtatgtcagccaacttgcatgcacgttttccagcttgtaaggcaacaataagtataacaatacttatcagcaaagttcataatactatcgatgctcaaaagttattttttggtgttttagaaaagtattgtattttgccatataaaagaaacaaagtgttttgtatggaaactgaaagtatgttggaaaaaccgatttattctaaatttctaaattatatcttgttgaaatcccatttttgagaacggcatcaaaattagcgatcccaaacctactagcgacccataatttaatccttgggacacgcaaaaatgtatttttttttttacactgtgtaatcagcctgagtataccagttatgcccaaagtggttccttattgcaaaatatgtacttgataatctgaatgttttcacatttgaaaagatgttatgtgcttaagcaggaagttatagattatatccttatgtaaaaacattcgaaaagattagaaagttttcgacattatacatatggccaaataggaaaccactatgaccaaaactggtacacttccctacctgtcaaaaacatcgatagtcacgtaaacgacattaactatcagatgtttcattggaagccgtcgtgaattcacttaaaaatgtaggctttgaacggtcttgatagagatttacgaaaaatgcttcaagaagctcaagcaagcgggttcgtttttctcgacgctggagtattttttttccgcttcaatcaaagcgtggaaagcaaaagtgctatttttcaattagtctgtacacgttaagtgaagctgaatgtgatttgtggcaactcaggcaaggtcggaggatcaatcggtgagttcgttttatgatattattaataagtatgactacacatttttatcgctacaacggcgagaattttacgtaaatatgatcattcgaccaactatgaatggttcgtcgctgtacgtgtcggcataaactcttattcttaatttttttatgttctacattatgttataaaaacacaccactttttttgtaataaaaaaaaaacacttgctaaagagtgctcgaagggcccaagcaagacgattcgtttacgggacgccgagaagtttgcggttcgcgttgtgcgagttcgaaaagatattcgtgttcagtcgaggatggattaccattgaactggtgagctcgtttcacgtttatgataccgtaattccgggtgaaattgatcattttcactgttttccatgcctcctcttctcttcttggcattaacgtccctactgggacagagcctgcttctcagcttagtgttcttatgagcacttccacagttattaactgagagctttctatgccaaagttgccattttcgcattcgtatatcgtgtggcaggtacgattatgctataagcccagggaagtccaggaaatttcctttacgaaaagattctggaccgaccgggattcgaacccagacaccttcagcatggctttgctttgtagccgcggactctaaccactcggctaaggaaggcccctgttttccatgcctgttttctataacgttaccaatggaaaacaactgaatgcagggaaacaagtacgacgatgagcctcatcggcttatatatcaaaatttttgttcagatgtgatttttgtactgaaaatcgtctttaaaataaaaaaaatcaaaagctcccatttcggggtgaaattgatcacttgtcaatgcgatcattgttagttttgaaaacaattttactaacttaatttggacttcctgaatccagatatgcttgctaaattcttgacaatgcaagatttttggaaataataagcattgaatgctcaagaataccacagaaaacgcccaaaagttccgagatgaaccagcctcgggctgcaaatctcgttaataaagataataataataataacgcccaaaagtaagctattttcgaagaaattttctgatatacctatatataaaaaaatcgattatttcaacaaaatgagcaaattcgtacgaattttgataataaaatctgttttagggatatattttgagcctccttacaaaatttcaggttgacaccatggccagatccttataaaagaaaactaaaagtttatagatatgccaataccacaccgaagacggttatggaattatacacaaaaaaagaacttcacaacatacaattcgataatagttaagacctgggagggaggcaccgatactacacacgaaatatgacacaaagttatttcaaactgcaagaaaactccaacttgccaacgacaatcaaggcagacttgatgaaaatcgctagctttcttttgttgtgtaccttcgatttttctggacaaacatggaaaaagggccaaagttttctatacagttaattttcgtttttattggaaaaagtgaaattagtagtatttgaatacattatattcaatcagcataaaaggtggtatcgtggcattacttttgaatcagcatgaatagcttttcaatcgtatttttgtcacatatgataaaatacaaaaatatgttttgggatcgttcaaatattacgtaacgcaacagggggagggagggggtctcacatagtgttacggtccatacaaaaatttaaaattttccatacaaaagatgttacgtaggggagggagggggtctaaaattggcaaattatgcgttacgtaatatttgaatgaaccctttgatgaattacgcgcttttatcatgtttgtccattgtttaagatctgggctcacagtgacagttagtgacagcagaatctcggctcaccttcattgatttttgtgctctattagaagaaatacaatcgtatgacacggtgatcaatttcactcgaatttacggtaactcattttttcatgacagcgttacttttatgtaatattcaaacaaacttcgtatggttcgtcactacaagtgttggaattgtgcctgttttatacaatttcaatatacatatattttactatttttgacattacagaaaacatcttttgaatggttcgacataatggatgttgacgtatttttttaaccttcttccaaaaacttttcgtctcgagacaaaaatgcacatcggttattcttataaaattctcaaacaaactatgtcgtcactacaagtgtcggcattattcctgtttcaaataatttaaagcatatacattatgcttttctcttttcgtcattacttaaaaaacttttgaattatagatgttgacgtattttttaaatcttgtaccaaaaacttctcgagacaataatgcaaaactagctttgagtataagtcgtatttttcctctttatccatggaacgcatcactcccagatcttttcttgcctcactaataaacacctttcccgtgttgattgttaagtgcagagttattctcggtctctagaagcaacagtcattacaccctaacgttcctaccactgtaaggacttggccggcgccgttattgatcaataattttagatccgctaaaattgcattacgagagtaagcggaatctcccatcccttattcatttggatcgtagtgcaattcttaccagttccgatcaatcactgagtagcaaccattgacatgtatagtcagtctatgctatgggatggaaaaacacttgctaaagtttcactttattcatcaaactatgaatagttcgttattttgagtgtcggcataagagtgtcctacgatggtccaatcaatcgagttcgtttttttttcgttttcaaatgcgcgaaatatgacaacatatgatttcgtcttgacagcggtaggaatattgcgtttatgtatttgttcaacaaactttgaatagttcgtcacttcacgtgtcggcagtaattttctttcacttaaaaatgtttcgtagtaaccaatagtatcatacttataagcttttttatatctcaaaaataattatttatcatggtcttatcgtttatcaaagaaaaacctatgacccatcccaacccaacccctccctattaacgaacataccttctagtaacccttgtggatatgcaatggtaaacacggtctccaaatagcaaagacaccaaacaccactgactgcaaggacgtggccggcgctgttattggcctaagacactacattatgcacactaaagaagattgtgaccaattacagctaaacttgtagttgattccttgttcatcttcactgactttggtcaatcaggggatagcaaccctagatatgtgtagtcagtctaaactaaacttaagttttaagcggtcttagtagaggtttacggatacctatgaagaaacgcagggctggtagcaagtcactttttagtgacttggtcacttttttcgacctggtcactaaaaagtcactattttcaataaaaagtcactaaagtcacttttttcaggaaaatggtcactaaagtcacttttttttcgtgatctgatgattatgaaattgaaggcaggttagcttttcaaacataaactgaaagaaataaataattgttattataaaggcaactgtagtgtaaatatgaaatcaatgtgtcaagattcttaactaaagaaaaatagaaactcccggctaactttctggaagaatcaggtgaatattccgtagacatttccaatggaaaatgtaaataaaatctagggaaaaattctgtcgaatcttacacgcaaaaaaattgtgcggtaaaaactaccattttagggggttaacttaagcgctcgcaccggcaattttcagcagaccagaaatgcgcttgattttaccatgtctgtagttggaatcagattgttgtaaattagttctgtcaaatgtaccagtaatgcggtggggtgtaccctaaacatagtaaattggactgaatttccatggtagttttaagaatgggcgtagtcagctaaaatagtgatttttaccacagaattttttcccgtgtagaaagcgacttaaggaattttttgtccgaaatatattgataaattttgataaaaatcaggacaattatctgacagacttgctgaataaattaccagtgatctttctgcagtaatctacggctatggaaggaatcctaaacttgccatatgaaagaaaaatatcaaaactcatccgggaataagccagagacggttagaaatatcatccaaaaaattcaaagagtttgtcagaaactcgtacagaccttctaattcgagtattaattttgctagaaatcatttcaaaaattatattagaaatgccaacaaataaactatacatttattcattaattatctcttagcactgtttttcatacgactttggtcaactttttctatacataaaacatgtttttatagagaatgcatgagcattgttgggaaataataattgattacaagtgatatcagtggctatttcctaggatcaaatccacctattcatgcagtaataaataagcgatttctatcgtttactgtttactttataaatctaagtttgcaaaattagtcattttcaggaccgtagatcagataaaacgtgtgattacgagtcgccactgagtgatatgattgttttcaaaaccattcaaaaccataacttattaaaacgatcagtttaatattgatatttcaagtatgcatggaataattttctaaggctttatgcacgatattcatataattcggtttatcgcaaattcgccaataatcagttgtgttttggagttattgttgtttatttggaaaaaatagttgaaattcattcacgattgtcgcaacttaaaattttccctcgaattgttccacagagttgataagaaatgcttcaagtaattgcaattttaaagaaattgtatttatacttcaaaatgttcaatggacttttgccagtaagtttcttatgaacatgagtttgtttaccgtagttcatgtatttgaaatcagaaatttagagtaataatctatatcaatctaatgttcgtatcgtaaaaataatctccaatgcgccatctttttgtctcatcccgaacagataattgttaatgatttgaaattactgcggttctctacattttaaatttactcaatatgtaaactttcgatatctgcatgtgtttaacattcgacaaaagtaggcattgagtaaatggaataccaagtgtgtattttatggcagtatgaaaaaaaaaactagaacttctaaaaattactagagactcaaaagtgcttattggaggatgaaattttgtgccgctcataccaatattaggtgaatagtcacaaaaaaaagatgccgataggagtttcatttctactacattacgaggctcatgtataatcttattgtgactgttatacggttacttgtaccagtgtaacaaaacatgtttttttttctctagaacaatcttacagacagaggcgtcgcgtggcctgtgcacttctaaattatgtcaaattcgtttttgaacctaggttggtactggcgcaacctgttctgaaccacagtttcaaccccaacccgattcaagttcgaccaaacaacaatttgcttgacgttggtttatttatgtgttgataaccgacccagttcctaaaaacgggaacaacattagtataattttatatatgtcattattaggtacatcttggattcaaaccatttttttctaaggtaataaaatgtataatcaaactttactaaccttcgttttcaaatattttttttttctagtctttcagttgattaaaaacatttatgattgcagatgctaatcgggttgtttagttttattttttcactttttcaattttaacaattagtcatcattatggggaaattgtaaaattgcatatgaaaatcattcaaattatgcgggtcatcagtttcgatttataaagcactggattctaactaatattgcaatatagagttagtgatcataacccccatatttttacatagaattaatacaagatcgttcgcttcgtgtacttggtgcacgtttcaagaaaattgctcgctttaaaccacaccacaagcgttatactgacgatgacgctgattgtattctgattgaccatcacaagtaccaccgcgctaatactgtatgctggaagcgaggttcttaaccagtattgtacaaaaaaaaaaaaaacgcgcgggccctgagtctcaaacttacagaaacttcttaccgtcagccgtctaaaaaatcacgccagtactccacaccacaagcgtagtaagttgaccgaaagtgtttatcatttgatgattctccacggtatcaactcgaaattggtttgtttaggggtatccagtttcttacatattctgaatctacgttaaaaattgaacaagaatcctaagtttcacaatttttcgtggcctggaactattttcaaaacacgtttgaaattagcatggaatttacttttgaatcacccctgatgttcggttttcgccttttgctggacagtgtgattcagaagccaaagcatgcagttttgtttttattttcgcattaaatttttccttcacgcgttgtgctgtatgtggtagagtaaacctgtgaagagaaaatgattaataaacgttaatttcatagagtacttaccattcatttgctatccgatttgattcactgtttattaaacctgaattgacgtttcatttagtaaacaaaacaaaatctatgcttgctatgatagcaacggtataatggtgttagtactctatgaaattaacgtttattaattattttctcttcacaggtttactttaccacactgtacaatgttttgctacggcaacccaagccatcaggatcgtttacaccactccgagtaaagaaaatttgtttttgtgatggtcgattgaacgttgaaatgcagagaggtttcaaatgcagaattcggtaagctcgttccaatatggaccaatgccaaaatattattcataggtgccagaacattttccaaacgtatccaatggtcgttcacatcccattaaccttccacaatatcccataacacctatgagaggtcaaagagttctctgcatctttcttaagtaggtgttcaaataatcattacttcccattcctcagcatttgcaaggatgtggccaggacagctctcaactgttggaggatgcgtcaatcttgtctaagagtcaagagttagtcccaaatctttgactttggtaacggacggggagaaggcaaccctcatacaacggtttaggactgtacctgggagggaggcacagatactacatacgaaatatgacacaaagttatttcaaactgcaagaaaactccagcttgtcaacgataatcaaggcagacttgatgaaactcgttagttttcttttgttgtgtaccttctatcgttctggacaaaaaaggaaaaagggacaaagttttctatgcctttcattttcgtttttattggaaaaagtaaaatgatgcgtatttgaatactttatattcaatcagagtaaaaggtgctatcgtgacattttttttgaataagcttgaatagcttttcactcgattttttgtcacatttgataaaatgcaaaaatatgttttgatcaattacgcgcttttatcttgtttgtccattgtttaagatctgggctcacagtgacagttcgtgacagcagaatctcggctcaccttgaagtacataaatttcgtatcggttcctccctcccaggactgtaccacctacgaatttgtgcgaattgcttaatgctaatgctaaaattcacttttgaatcactcctcggcatattttactttggggcgagctgtcatgtaaattgaaatgccattgtgtcgacggattgaaatcttttttaatcgtttatgatatcaacattaagatattaaaatgcaattaaatcgtgtcatacctagaaaaatttgctctttcgatcatactacaaaaaaactgagagtttttcttcactaaaccaatttttaaaaaagtcggatgtgacaaacatgcagttatgggcagtagaatggtttatatacaaatagaaagtattttcatttctagccatttttatgataaatacttgtagttttgaagccactttcaggtcacattttggtcactttttggtcactattttgatcattttggtcactaaagtcactattatttagctgtctaactgctaccagccctgagaaacgcgattaggcaagtaagagccttgttcatttagacgtttatttgatatcattttcaacatgttctcacttaagagttcttacatttgtgcccgaatgtgtagttgttgaaaagttcaagtatcttaaagcttttgacaaggttacttttcatacttaaaatgaagtttcaatgagatgtatatgaactgcaaagttttcttgaagcatagcatagcatagcatagcatagcatagcatagactgactgtacatgtcaatggttgctactccgtgattgatcggaactggtaagaattgcactacgatccaaatgaataagggatgggagtttccgcttactctcgaagtgctattttagcagatctaatattattgatcaataacggcgccggccaagtccttacagtcagtttggatggggaaggaatgttagggtgtaatgattgttgcttctagagaccgagaatacctctgcatctccacaatcaccacgggaagagtgtttattagtgagggaggaaaagatctgggagtcacctctggtcgatgatgcgatccatggacaagggggaaatatacgacttatatttaaagctagttttgtatttttgtctcgagaagtttttggtagaaacttttaaaaatacgtcaacatctataatgttgaacaattcaaaagatgtttttattaatgacgaaatctgaaaattacatatatatacatgttaaattatatgaaacaggaataatgcatacaaagtttgttttaatattacttaaaagttacgctttcaagaaaaaatgtgttatcacaagcatgaagcgaactcaccagttggtaatccatccttgactaaacacaaaactgacactgatagcgaaacttcttggcgtcccgaaaacaaaccgtcttgcttgggccttcccaaatacctctatatgaactgcaaaattttcttgacgaaattaaaataaaatggtcgattatacggatttgaatgaaacagataaagcaatcttcttcttcatcttattggcattacgctctcactaggacagaccaagcggattttaaccactcggctaaggaaggcccaaacaatcttaaaactagttataatctaaaatgttacttttggagatagagatggcattatccttaggcttcaggcctagaatctgtgcctagaaacaatgtaaatgcctgataatgtcttcacagtgtcattgtcagcttgtaaatgaccataggctcaaatgactaccgctccgtttgcgcaccccatctactattacatccttccttcaataagtgtcagtaccggtaaatagaaggtacggtacgtacggtaacttaaagccaagcgccgccgtgtgaaacaacaactttggttcgtcgcacttttcgcgctgcaacgtacggagtcggttgcatttgaaatgcataaatgcaatttgttgggacatttatattgtttgtttactattttagttgcggcagaccgcacctctcgctccgcagtcgcgcaaccggcgtgtttgctgttgtttagcgctcattaggcacggacggagtctctacctcctgtagtcagtcagtagtgcagtggttgactactaatggctctacttgtcttgttagttttttcttgctagatggtttgcttatgtcaaatggatacgaatatgtttctagtataggaagatatatttgaaaacatattatcttgaactttaaaatatgtaaactaaactaaatttggccatgccctacaactttgcaaatctgatatcctgattatgagcccttaaggtgaagatgaatcgaagccaaagttcgaaaatttcaagcgcacggatctggagaaccaaacacccgtttgagctgaaaacctaatcattggtcaccaccagctagtgaccaatcgattaagtttccagcttaatcggaagtttggttcaccagatccgtgctcttgaaaatttcaagtttggcttcgattcatcttcatcttaatgcaaaaaagtataagtgaaaagtataagtagtgttcaaataggcatgtcctaaatcatcacgaaggatatagtcgtttttaagattttaatttgcattagcacaagctacaatgtttcgaatttgcgaaacattatgtagtatgtgttaaacgaatgccgagtagtttccaatgaacagaagttacattaacgtaatatggaattacgtaaatgggattaaaataaatagaagctacgtgaattgaggtttctgtgtgccattttgtctctatgttcctcattgtaaaagtatgatttaaaatacagtcaactctctacaactcgatagatttttcggtatcttcaaatttccatacaccatactctccatgagtcgatattcccataactagatttccactagtcgatgtcacgtgagagataaatttctctctagaactcaatatctatttaaaacgccctttttactctgagaaacttgaactaattcttgtttggaagtgaaaaattacttgcaagttgtaatgaaagctgaaaacatgaaaataaataaaatgattgtccgtaaaaattacatgatttcatcagtattttgaaataagttttcaaataattgattccaaaatactgtcgataatataatattactttttagaagtgaccagaatacagaaataacttaatggtcccttgaatatcgagctatcgagagtcaattgttgtttcttgatttatcattactctgcatttaatctatgcaagacactacaaaagtctgaaaattcactagactgaaaacaaggacaaaaggcacaacagcttaaatcgaaataaaaaaaaacagaacaaaacccataaaattacacaaattgcactgaccagtgaccaaccaataaaagtgcaattccccgcaaccgagccgaagttctcagagtctcgagttaacaacgcaccgcacacacgatctgcgctcttcctctcactctcgctcgcacattatttttccctgccatttttacccacaatcacccagaatgaatgaaccacagcgcagacctggctgaatgaccaatggaaaataaaaaatagcaacgaatataataaaaaaaatgcattgcccagaccactctcaatttcaattgctgacctacttgccaagttgagtcgaacgccacaccgcttcgcgtctcaccggaaccccgcttccaatctgatgtggtggatgcaatctggtcgcgcgcgcacacacggctcagttcagttctctggccgctctgctcttgacttaaaccgcggacagaaccaaaagtggaaataaatatgaaaaaaatcgcacaaacaatcctcggcctgaccaaacaccaccacagacagcagtggggctcgctcttttgtggtcggtgtgttggatgtacttacccctatggttgtaggcacgaagggtaacatagctcaaaatggaccaatggggtaaaatggccccatttattgaatcattccaagaaagatgcaaagtactgaccattaaaacgtgatattgatataagtgataaaagatctaaatataatatcaaaattttactcttaaaaaaaatggatgtatacagttctatgtggttctattgaatggatcgctgctattggtaagattttacaaaagctaaatatgatataccaatggtattctaggagtaaaattaatatatcatttctagatcatttacctcacccagggttgggaaagatctggaaattcactcgacagtagccaagcaaagcaaagcacagtcagcgaaaccagtgaaattcacgcccatcgctgctgtaggcaaaaagtcttggaaacagtaaaacacccgttgctaagggcaacccaaaattactgtaaaaattgttctatattttcaattttagcgttgcgtaataaatggatgccgcctaatgatttagaaaattcatgctcccatgataggctacttgatgagattcacgctttcaaaatactgtactgggaagagctacgtaattttcgcgaaattcaagcctactactattaccattcccagcactgatcaaaccaaattttgaaaatttttcacttagattctaagtgttttagagtacatattgacatgttgtgattctctgagtttcacaatcatatctacacaagaacacccataccaatgagagtatactatatgctaaactaaatagcgttttaaccaacccattatgtcaaatagaacaatgtccagttttcaaaatttaacatcaaatttaggatatgttttcatggtacgcccagaaaatgttgcatagctactttagcccttcgaatggcctcaaaatgtggatcttattatgaaaacacgacaaaaatccttcaaatagcattttagatcactttcccctattgtttgagtattccatgaaaacatccatctatccagcacaacattgaatccatcatcaaggcagggtccatcttactactgctgatcggctcgaaacgagtaagccggtggttgccgagctgcttagtgtcacggaccatgttcactcgatgttttttgacatttgctcaagttcataaggctgatacaaatattaattttcttttatgtcaccccccccttcaaaaatccgaaaattttgaaggggaggaaaaaaaaagattcatcattttttgacattagttacggttttttattttttttaagtaaaaaacaagttaaataatgatccacaggacgattgaaaaaagtttaacaactatcgttaaaaataaaaattcgaaaaaataacttttttttcatttttatttttttgttccttatttatttttatcccccccctcgtaccttccaagtggtctcggacataaaagaaatttaatatttgtatcagcctaataagtcgtgaaaaactcgtagttataaaagatggctactagactgatgccaattttgtagtttttgattccctatacttaaacggtgtcaattagggcgtctgtaccagtgatatagacaatagtaacgggttgaggaataaaaaatcgccaaaaaataacggaagctcgttttttatatctgaatatgtcattcggaagcttttcttttctatttcatgtacaaaataatctcagaatgataaaattattgaatttttcaaaaatccacttactctattactggaacatgtttcagcaatagtggtatttgctaacacctgttcctataatagtggtttacattgatttcccattgagactcactattataggaaagctccactattactggtggaaaggagcaaaaaagttaaggattttaattgttttctactatttgcttactgattttcaagattatttatacacatccacatttttttaacaagggtcagaaaaatatacataaaaataaaaattgcctataacacgcttgaaaccccactaccattattattggggcacacactaccactagatcggtcaccctactatgaaaagagctccaatacaactattacacaaccagatatggtcgtatagcagttgatttgccttaattgccgcatgtgcgttacttgagaccgttctgggtagagtttctattccattataatgaaaaagaatccacaaacaaccgatagtattagtgtctctcaactcttgagcaagtttagaagcattttatcaagaagtgtaaggtcccttatctgatgatagctataggagtaccataaaacggggtaagttttttcgaaaaaaaaacttgaatattcatgcatgctgttttaaagaattataatttatatttttgaaacaagtactggcatcctagctatcgattgcagttgttagattgccacaagatttaattttaatagtatacaatttttcatataatcgaaagtcgttttctgttctggggtaacattgataatagagtgtaaatcctacaaaattgaattaattacgtcacatttatagggaattgcatacctctaggcgtttaacgttgtagggaaatttcgaaattagattacaaaaatggtcccaatttgtgaacactcttttcgctaagagatttgagaccagcaatagtgtcaaagaaaagtgaccaactgttcaaaactacatcaaatagtgatcgttgaacagattgttttcaaaatgcttacaaatgctaaaatcgtatatttttttaatattcgcatataaagcctcaaatgttctcgattcaaatgaaaacagctcttacatgaagtgtcatactaatattgtttagttttgtattcgttttgcttaaccgattgacggaaattacgatatttcgtttattatgtggtgggtaacgctctatcaaagttacccgcattatcaaagataccccgttttactgtacttatattaatactggttctcacacgattctatcgattatgattgcagtcctgacggttttttgtatctatcagatcaaatgtagtatttttttatgattgggtaattttcaaacttgttggcgtttcataagtagattttctttaaaaatgtttttatccttgtcctgataaagaatgtacactatcctgtcaatgtctataaatttacaataacaatcaaagacttcagcaatcttactaggaatcctgtaaagaaattacacataaaaactatccgtttaaaaacaacgaggatctagtaccagatatattgtcaattgcaataatttgatatagatcttacttacggtatacctaagtccctaatcataaatctgaaatagatcctaatgaaaatctcgcatgattatggaagggaaggatttttcaactaaattttgttagcaatttctccatattttcactaacataagtcttaaaaatgttaaaatctgaaaaatgtctgaaaactcaggcctatgcaaaaacatgcgttctactccgaaatgaattatgcgtctcccttttttgcgagtaaactcaaagcaaggtgctggagacaaattgtttttgtgctagacatagcgaagcacaatcgttactctttcaatctctctcgtgccaaaacaaaaattcactctaggaaaatttcagcaaggtatgttttgaaggcggacaataagtgctcggcaaaataaatatagttgtgggttcttttatttttttttgtaaaatcagaaacatagagcagtaatacattatgttcatcgtgttaaggagttttgacagtcgcatattagtggaatgaatgcaagtggaatttttgacgcatgtacgaaacgccaaaagtgaaaataatacagctcgataccacgcagtccatcgctcattgcgagtcaacactgccaggtctgcagggcagaaaaaatactcgtgcacgtctcttgtgaatttaaggtactgtgcgtgataaaaatttaatcaatttttttttttcgctgaaaggcatggtgttcattttactaccccgttcatttaaccaccacttcccttacattcaaaataaaattctgtgtagaactacttttgaagcttctcaaaccattgatgcgcaaagttttcttaaattttaatgctccataatttccaactgcttattttgaatgctctataaagtctaattgccaaatcattaattgaaaaagaccaaaaaaacttctccaaaaaataggaataataaatcggatataattttagagaaattcttgaagaaattctggacaaaaaagaaaatgaagcgaagtcacgcatcgagttttcaaagccacaaatctgtagagccagacattcgttcacgttgagaacttgatcgattggtcaagaatttctcgaaccagaccttactttgttatatgattgacagtagttaacgtaaggcaattctaaagatatgaagctggacagcctcaattgtaacggtatctttgggacaaaacattaactaaaataataattatttttaatacacctatcaaataaatcctggactctctaccgaaacaaaccttcgtcgtgacatggttcaatagctgtcaatggtctgattttatccttgattgattgttattttaaaacgaggttcacagagctttaagtaaaaaatagtatttccttcgtggattatttaatgcacacagtttgagaaacactgaaacaccaccgaccggaataatcgccactaaagcgcggtccctacgccactgccaccctagcagaggcaatcggccaaagtgtgttgcaaacatcaaacctttttgtacaatgccaccgcaatgagtaataaatgcggacaaaaatgagttgatttcgttgttattgtgtctgtatgactgtacgcctcttgtactttagtaaacacatgagttgtgagtttaactcctttatgggatttagttgattcagaattttaacttcaagagatttttcggagcatttcgccaccatgtacagtcaactctcccttactcgatattccgtatctcgatatcgagttacagaagcataattatattggtgttcctggctacctcgatggtcccctggatcgccgtcgcactggttttgtgttctgtaactcgatagctcccaaactcgatgatccctccaatatcgagttatggaaagttgactgtatctagaaaattgatacatacatggctttatcttgtcctaatatgttcttatcaacagttaaccttaacgatcaacgctccgtcatggtaataatcttcatcatcgaaactgcaaaagcagtttttcagctcaaaacagaaaattattcgatgaaaatgtgttcactgggtttcggttggagaataaattacagtgaacacattctcctgtaaatttacttgattttgaacgaaaaaactgctttcgaaaattccgaaatcaatgacggatcctgcccccttcattactgtcttcttgtaaactaaaaccacaagatacaacacacatgaccaattcagactgagtatgattttttttaaattttaattcccttcccctaaatcttcctccagcgaacgaaaaatctgtccgaacgcatcaccgaatcagatcatgtctctccatttacttacggcaatctcagttgaccatggcccagattcgtgccacaacaacatcaccaactgacgctctgctgcctttgcttgacgactcaacttgatgctgtgctgaaacgcatggcatggccaactgttgatgtttttattcccttccaccaccgacgccgtcttgaacgccgccgtttcgattcgtcgtcattccgttcgcatctacgcataaatatgcgcatagtggctgcagcgtaaataaatcgggcgggaattcccgccctcgctcagtcaggtggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgattgatttgactttattaacgagatttttagccctgggctagttcatctcgggaccaacggctttacttcccttccgaaggaagtcgtcactataactttttacgtcataagtgactatgtcggggatgggattcgatcccaggtcctcggcgtgagaggcgagtgttctaaccactacaccaggtccgtccccctgtacgcaacatgagtgagtacgaaaagccagtagagcagcgagctcgattttgcgcacgggggtcatctacacctaatacctttagggtcattgggggaccacttagcgtccacgtaaggacttcaaaattttatttgatttttttttcttaccaaaacgagcactttacaatgacgaacttataaaatttcgcattttcgaaaaataagggacggcctaataaccaggtattgtcaactcttcaatttggtattattatggatttgaaaatttgttttaaaacaatcaaaaaaaaatctcagcgaagtattcgtatgctattggggtctgcttgaggtattgaactattattgaaaaatcatttgtatataaaaattcaatgtgtattatttaggtattgcaataccagatctagttatcagtttggtgtttgtagaacatacatgagatattatttgagatattttaaatattgaaaattatctagtacatccttgtatggtactctgtagcaattttcttttactcgggttgccgtgtgtccagcatgatccggttcgcttggtccagtctgtttgcactcggtgctagtgctaatgaatgattgtccgctgattgacaacgcgacgacaacgacgcggcgtatattttcgttgtttttggtcaaccatcagcgtgggaccttaaatgtgtagacaccaatggaaatcggtgtctagagattgttgatcgaataaggttttatgttgtttattttttcggtatggctacatactacatatttttttcccacaaactagtctaggtttagttcaatgatattatcataatactgatgtggaatctacttcagtgactcagatttttcgcaaccaaatcatccatgtgaaatggtcacctaaaaagaccacaaacttcacatcatggagttctccgagttcttatgaaaatgggttgtcaaacccaaataattgccaggttgcttctttgtacaggctgcgtctgtgttggattaaataagattatacaatttcatattctaaggcaaactctgtaccttaatccgagttacggaggtatcgagatacagaacacacttttttcaagttataaactttttaaactatgtgatgccttttcaacagtctgcaaaaattgaaatttttgttaccctaaaacggactgtaaaccttcattttactatcagtatagtaataataatcaaattcatagaatttagaaatatttggagagtgtttgaaaattttcatgaatatattgagttagagaggtaaagttgtttgggaaactgaaacagatagcatcgagttagggaagatcgagttagagaggtatcgacttgcagagggatcaaagtatcctatgctaaattaaaggaaccgcgcattccatcaagttatggaaaatatcgagatacagaatatcgagtaaggaagagttaactgtatctcaattttagttttcgctatctgaaatcgatctaaaaaaatatttgggtgaattttttcttttgcgtgttcatgaatctaggttatgttattcatactgtcttttgaacatccctattctagctcatatccttttttcttcaagtctcttcttgttaccaattttggacaatatgtgatttttttaaagtgtttacagtatttcaaaaagaaagatgaaaacttttaattcactctaaaacatttgttatttttcgtgtagttaacggaaatacaaattaagtagatgaaaaaaccgaatttagtactataccatttaattccactagagtttgtatcctttgacagatacgcgtatttcgacctcaactgtaaggccatcttcagtgtcgtgtactagactcgactaaattctagtactaaattcgtttttttcatctacttataggtattctattgaacagctcgtagatttattataatacaaattaatcaaaaagttacaactttcctgatgtgagttttaattgacatagctgttaataaacgttttttaaacgtgaaccagacgtataccatggacatttttcccagtaaaacaccatattttccatgattcctatgacaagatgtagactgttgaggaatacttcattttcatctagtggacagattttttcgaaattaactggtgatactggtggacatgatttcagtataaatagtgcatttcgcgaatattttaagattacctaccttctggtagtctggtagttcgtataaaaaaaattttggggagtccagagagcaattctcttggagagagaaaaagtttacgctctttacttttattacagaaaggtattgaaatcattcccatttattattggacaccaaataaaatgtcacgaaaaagccttataccaacaaaattggagattatgcatgcgtgcatattttatacgatgtaaaaaaaagcatgtgttgattgtattgcgaactcatctggaatattttgcgacttaatttatgataacaaagtttatttgacagctgttacggattgatccgacttactttgtacgaatatacgggacgaaacgaaatgtacatatctcacgttaagtataagggcgtgtctgtagtgatcgatttctcttgatcgattcttcctttagctaatttcttggtcgagcgactcatcgtctctcgtctcgattgaatttcgtgtaccgatcgttagagaaaatcgaagaagataaatagaccattgcagatacgtatgatacaaaatgcgaggtatgaactcataaaatagcgttttatgcaaggccaataatctatcaaaccatttcgtttaccaggtagtgcgggtaaaatgcaatttgtataaataaacgactttgttcgtaaactgttctgcgacttatggttgtctggttcagcagaatgtggaattgtatttcatgcacaaaattatgaaatttgtagaaaaaatcatgtcaaattgttttggttgacaaattgaacacaggacgtgtaaatatgagggtctagaagcaaagaggcgtaagataaaacaaaaccttgttttgagaatatcgacttagaagttttttcaatattttttcattccatgctaattgtatgggatccaataaaattaaaccgattttctacgaattatgatgtttttcctattggacggaaaaataacctgaacatacaactgaaaagccttaaaaaagtagatttttttagtatgcctatctctgcgaaacgtcgcttacacctctttgggtttcggcacctcaaataaaaataaaaatcattcccgtaaaattgttttgctgaagactagattaaagttaaaccaattaattcctacgatatgacattgattacaagtcccgtgtggaaaaggacggacctgttgtggttagaatattggtttctcatgccgagggcacttagaacgtaatagttatagtaatgactttcttcggaaagaaactaaacctgttggtcccccaaggctaaaaacatctctttaataaagataggagaacaaattagttattggccgtgattatcaagagtaatttaacatgaaaatttggttcaaagttgcttttttagttatcaataacctctgggctaaattttgatgagaaaaaaataacaaaattttaagttacgccctttttgatgtgtaaccatcaacaataataatttataaattttatatagactaattaggctataataccgtaaccatgctaaatacttttcaatgatacattgtacttacatgccgccaaagtctttcgcaattgattgaatttttaaggctcgaccgctataaggcattacggagacatttttttttattattattattcataaaatattgttcaagaccaagccctactagatgcccctcatctgttccggctaactttgtacttctcaaaccttcacgagttggctcagagttacgagttggcttcacgaggagggctcaatacttgaaatacgcatgagaaaactaagaaatatccgttattatttggtttcattgaatttgaaatcataacacttgcatgcaaagcttaattttacatttcttctccaaaaatcaatactcaaatcaaaactctcttgagaatattcatccccataaaaactaaaaaaaaactgacggtggtttcaaaaaaatcgaatggaaattgacgaaatcgcagctatctgaaaatgccttgtcggaggtcggtaacgtaaaggttaatcgtaatacgaacacttaaacacgcaaatatttcttatgagagttgatccattcctgatccatggatgataatcccatacctaatctgtcacaaactccatgtctatccatattcttgatgattttttatcacatgcgcagaattcaaaagtttgacgttttttatgtttaaatcataaagaacgagctcaccaattttaaatttattagtcctacacggtgccccgacagaccgttattatgtaaaaaaaatgtccatcaaatctgagcacagggctcgattcctgaggtcatttcgcacctcttggccaatttttaaaaaaatccttaggaggaatctcaagaaatcttgatttgaagttttttacttaaaaattcaatataaaccatattaaaattttgcaatagcactgaaaaaatctacaaaaacgctcaaaaagttggctcaactgttcttaactagtatacaattgttaccgttgttacaattttaaatatttacatctggcttaacttaccagatcggcttaagtagggggagatcccccagtaccggacacttaagccactaaattcataattcgaaaaatattggttttatgtgctcgtgttacccatttatgataaatattatcatttttatagtgtacaaaaacaaatttaaatatgaatatgaattttgacattgcattttgatgatgtattttagtaccaaattgatcgatcttgaaaggtggcacccaataccggacacaatctggaaatgcctcgaattctgtaaatttgaacatcattgaatgtgtttactttaggaatagtatataattgtcaattcattgcatttgcaacatttacaagaacaatttgagtatatcatagtttgcaagatgtccatcaaaaacctctttcttatatgatgaaaaatagcacattttacgatgttgtactgaatgttcatttttcttaattttattgcatgtttgataccatgatcgacggaatccatgaaaaatgaatgtattttgagacactcgtgcaataattacaaagatatcatataaaaaatcaggctgtccgaaactgggggacaggaggtgcttaaacaaaattgtaatttgtccatatttagtccaattatggtacaaaatacattcatactatcaaattaggattatgttcaaatatgcttgcgtgatccaaagtattttttcatattcaaaatcattactaaataggctcaaaattaaggcaatacgtcaatttttttgaaattttcaatcttttgtatttttttaaaaagacatgcatatttcaaggatgtgttattctatacaaacattagtctccataatagcttactttactactaatacaccatcttgattggactatgatttctcaacgtttcgactttgtccggtattgggtgttgtccggtactgggggatctccccctatatttttacatgtattaaaccagtaagctttgttaaatataatgaaatctaagaaataaatgtcaatatacaattgatgtaacgttcgataaacatgaaacattcaatgcagaatattatgaattgacagcttattttaagactttcatagtgcgtgaccagcccaccaaagtctgccgtatttattttgtttaataaaaatttctcttttacatctggtacttctcttgatgtttacatcaagttttccaccgagtactgccctcaacacttaatataaaaaatgttttgttcaacattctcagccacaacaggattatgactacacgagaaacatgattgtcatatggtcggtgttcagatagactgaaccaagtgttttttaatggtttcaggaaaacgtaccccgtgcattcggtataagtataatacaatatgtgcattatttgcttatctatttgaaaaaaaaacatcagtttcataatagaattggaaatattataattgatggagtccttgacttatatgtatttgcaaggccaaaatgtcatctagtcagatctgtttctccattggttcatcgattggttctcgccgaaaaccaatcgatgaaccaatggagaatcaagttcgcggcgattgaaccatagaaaccattagtcagatctgtctgaacaccgaccatatgtagctattgttcgacgattaacattttcaaacaaattcccaataagtactatttaagaatcaatttcactaggactttcactctgtatatctgaaacccttaacttcgttctttttttttcgggattcaacatcaatctgtatatttacttctaagtcgcgttcgactcagtaacaaaaaaaaaaaaataactgttgcaggtaacatcaaagacttaaaaataagacttaaagctgattaagctgacaaatacaatcaggtgtaagaattatagaccaggagcttatttttgttttgtaaaattacttgaagagatgagtttctgagtttactgatcaataatgcgttttgtcacatatactccttgattttgcagacccatgactttattgtaatcgatcgcagttcagtaaagaagggtttcactatttcaaaaatggacaactaggataaacttgtaatgcccaaacgtatatggttacatgtagagaaagaagcaggttcagatgtgttggtgctgaagcagtgcttgattgagatgtggatcaatttgttgaagagccatataacacttaatacgtatgataataatgtttcccttgtagtaaaaacacgtgttctggctgcgaatatctccttttaagaattacgtaaccagcttagggaaccgagagcaaagggaaacgacatttctacactcttgctttataaaggcttatcggacttcatagatccattatttcattaacaacttcgccaaaacacttcgcgatcctttattgtacaacactgaaaagtgtttcgaaaaccaaatcagttttcaataataatgcaaagaaagcaacgatgaatgcaagcatgcctaatagaaacgtcactgttaatttgccatgtataaaacgcttattcttggctcccttagcacatttatttgagaacaggagtgaaaactattggtcgtttagtgcgaatgccggaaaaaaagttgcatcaatcaggtgaagctcagtgacccctgggaagacatcggcgtatgatcattctgttattgacttgagcttaccagagtaaccaaatcattcaaaatttgaaacaaccggttatactagctctcattgactataaaagtattccaatgccttatctgctaactattattgtgctacatttattctcagatcctttttttaataacaacattgttaattattgatttatttggtttacttttcaatcggcttagtatggaaaacaacaatcaatgaaatttaaaccagtaaactatgaaaaaaagttaaatcgaagccaaacaccaaattttcaagatcacgaatccggaaaaccaaacatccgtttaagctgaaaacctaatcgactagtcataagctggtggtgaccgatcgattaaatcttcagcccaaacagatgttcggtcctcaagatttgtgcttttggaaatttgaggtttggcttcgatttaacttattttatgattcatcttcaccttaaggagtggattaagttgagccagttgtaaatatttctaattttaactacggtagcaattgtatactagttgagaacagttttgccaactttttgagcgtttttgtagggtttttcagtgcttttgctaaattttgatatggattatattgaatttttaagtaaaaaacttcaaattaagatttctcgagatttctcctagggatttttttaaaaattggcccagaggtgcagaatgacttcaggaatcgagcactgtgctcagatttgatggacaatttttttacataataacggtctgtcggggcaccgtgtcctactctgtgtttaattcagctttgcggctgtcaaataatttaaccctctaatacccaaccccgcctttagacggggtacactttggaattttgtgtattttttcgtagctcggaaatcaaaatgattttattttgggcttataccttgactcataacacgcatataagaaaagttttttatgacttttgaaacttttttgtatttttagaaattgtttgaaaaattgcattcttatacaacctacaaatgcctgagcttcatttaacgtgtaatataaaaaatcgtacattttatatttttctacgattaacctatcacaaaagaagagcctggtggtattaaaatcatttcaaacctgtttttccgttaatcacacgaaaaataaaacacgctccgaaaaaaaattaaaaatttaatatttttaaaaataccgtaacaatttaaatttttattattgccaaaaatcaacaactagaaaaggcttcaagaaaaaatgaaaaaagctagggatgttcaaaaataaaaattataaaaatcaaaaaccaaaatttaaaaatttgcgaataaaaataaataaatgcccaaaacgtgtttagaacgattttagataacgaaaaataatacttaaatcgaaaataaaaatttgggtattagagggttaaattcaggaacgccttctaagacgcaatatatcagaacagtaccgcaattgcactggttttgtgttctgtaactcgataccgaccgaactcaatggtcccttcaatatcgagttattgagagttgcctgtatattcaaattaccaattacgcaataaatgctttcaaattctggtcaattgttgaaatttcactaattttccttctcaacacaactaatgtatatctctttttccacgattcttccaaacaggtggacgaccagatgaagctgctgcagaacagctggtccgacatgctggtgctcgatcacatacaccagcggttacacaacgggctgccggacgaaaccaccctgcacaacgggcagaagtttgatctcttaggtttaggactgctgggcgtgccgagcctggccgagcacttcaacgagctgcagaacaagctgcaggagctgaagttcgacgttggcgactacatctgcatgaaattcctgttgctgctgaatcccggtaaggatcgactcccggaagctcccggttggatttatcctgggtttgtggaagtctgcgtcgaaatggcgtcgtttgcgttccgtgatgacttttggggtgggagggctatcatggtggtactcccaattgatttagcattttctctctccagtagaagtacgggggatcacgaaccggaaaacggtggtcgaaggctatgagaacgtgcaagcagcgctgctggattacaccctcacctgttatccgtcggtgcctgtaagtattcgatgcgtgtggattagggtggggcatataatgatcaaactaacccatttttcccccattcgccaacaggataagtttagtaagttgctcagtattattccggaaatccacgcgatggccacccgtggcgaggagcacctgtacattaagcactgtgccggcagtgcgccttcccagacgctactgatggagatgctgcacgccaagcggaaatgaagccagcgccgtcatcgcgtcgttagagtgtaaaaaacaaaaatgggttaaaagaaaacaaaatgtgatcgccatgggcgtgggacgggacctgggagggaagagcaactacatattttttgggaagcgaagacaccaacccggaccatccaaaacccccggaagcagcgtagtagtgttagtagcagtgcagcagcggcagtagcaaggatgatgaacgtgttgtggcgaaggcgaccaagcgatccaagtggaaatgtgttcttttcttcgtttcttcagataattgtgtacttttattgtgagttgcatcgaaccgagcgaagcgaagcgattgttctttgcttttgttgttaaactacgtttgtaataatttaacacgttagctaagcgtccattttgagcgaaaggtaagtgtaactgtgaactgttgctgcgacaattttatttgtgattgggatgaatgatttttggttttataaatactagagtggctaaaaagtagaaaatattacaaatatggaacatcaaatcgtgtacctttgtatcatagactgtttggtataactctctgaaaatttccagcaaacagttggaacagttagttgttagtttagaaaaaacagcttttgattttgtcgagaccgaaaagccaatctaacatcaacaagacaatacagtcgaacaaccaacaaaatgagatccatcttcgttctgctagagttaatggtcaggcctatcctcgttgcctcccgcttgtctttcccctaattcacaggtcatcgattccaataaggtcgatattgtccgctaagccaaaaatgtgaccgtgtgatggtagtgccctcgagtgcattgttgaacagtaagggccctattttataagtcgactcgatcaaaaacgactcgactggagtcactattgtccgaaaaattcgctcgactcagctctgtcactcgagtttatcgacagttgtcactttatgtgactagattactatgggagtcaacgggtgacatctgaaatatgcatgcttgctttgatcgacaatgactacagatgagtcacatggaacagctcgatttacaaaatagacccctaaattcgaaagttcgtctccttgattcaatccgtctaacgtgacaaacgaggttgacacctcgtctacaatcccaacacttgatttcgaaccatccaacctttcacttatcagcctgattagtttcgccggagaaccatgttcagacattatctgttgcagctcaattctttccactgaatcgtacgctgctttgaaacaataaacagatggtgaacatttggtccgttgtcgagcggccctcacgaaaacaggatgcgtgacagtatgttgtacgccgaattcaacatggtaatacctctgtaattgacacactccagtctgtgccctttcttgtagattgggcgtattaggccatccatccaaccggtaggaatttcatcgtcctcccataccttctgaagtaatcggcagcttacagttcttcagctcgctgacaacctctaacctctcttatagtctgtgagtccacaggttggctaaggatgaattgcttgacagttttcatcaatattcaccctgtttctcgctaaattttcatgtttgccgttcaaaaactgctgtaagtcttcttccacctggcaaattaccctctcgatcattgcacgtgggctgacgctggaacggtgttataccgcataccgttaaccattgcaaaaaatctccgataatcactctgttttatgctatcttgagcttcagctactacactttctttgtgctgcggtggattcgcttttcttcagctctcgctgccctgtaccgctctctgatctgtcaggtaccgaccacaagcacaaggctcataacgacattcttcacgcctgtcactctctggcacactccatctaaccagtcgttttgccgtcgttttgtataacagtcaaacataattgctttggatagctgctcgaggggaccatcacagtaaccatgactgttttttagtatggtttcaggttccacgagtcgatatcgagtcatggaacatcgactcatagaggtttcgttgtacccctcaactcgaacgactactagacctttgttttactagcttagaacctgagacgagactcgcgctgttcaaatcctcacatgaacctctcagcaaaaaatgattgagtttgcatcacatcgaatcataaatagccgtttgagtgaaatttcatgccagcaaacgtagcagacattagaaataattaatcttctgcttagatttatcagcaactttggaaaaaactgctccgccgaccgaggtttttaataacagtttactttgaacacaatacttttcaaattttcagccataaaaacggtgggctgcatttgacgtttcgtgagaggggaatctgggctgcatatgacgttgatatttttcctcttcgcgagtctctctcagtttagaacacattcaggatacaattattgtaaaagcggccgctcctctcgttaaggattgtcgacatcatacacatatacaatattatttgcttgtttaattaattatgatcgtggtttacggctaaccagccgagtgtgaatttaacaactatcgatgaactagacattacatatattttgcaattgggtaaaatggacaaatggatgtgaaatttgcgaaaaagttacacttcttctcggtgtgaatcgaactcacaactcaggttaacttctgcgtccatgagtcctctcgaggcgtaggggtaacgcgcccgatcaagagaacagggagtcgtgagttcgattctcaccgagaagacgtgtatctttttcgcaaatttcacatcaatgtgtccttttaatccagttgcaaagtatatataaaagatttgtttttggaaagtatatgtttagtttctcggcacttttttatgttcaaatttaattccggtattattatttcatagtaaactcaccccaataggttatgagcctggtgtaaagtggaatttgtacggatttgtgggcatttagtgaaaaatctatcggtgaagtgattttcgttgttcgcgtcgcgagtaaacagaattgcggatgcaaaagtgtccttggagacgatctggaagttcaagatggagctcattctgatgacctttgtcacggatcctaagcctggtgtgccggcagcgggttggcctttgaaagacggaaaaaccagagttgctcaatgtcagtcatatctgctgatggctgatggtttaaaactatcaatatcagttgcgaactatcaatatcgctttgatttgacaattaacagcagtgatgtgacatcgcaatctagatcaaaatcactgcagaatgagtgatcacgtggtaattatccaagcttttactgtttttcaatgaccaacatacagtttcagttcattggcagcactatcgaaaatatcgtactgataaattgttatttaaattgcttaatgtaaaactaaacttaacccatcagtgatatccatagtctatcaccatcaatgcactagtgatggagtagacagcatgatgttgatgtgatataggatgatccgatttgtatcgcagtcggcctgtacaaatcaacaaattttaagcattgatagtgacggcgagcaactctgggaaaaactcgcgcaatgatcggcttggcagtggaagacagtcaggtaatgcatatcatctggaagaaaacagcggaagaaggcgatcttcacggacacctgatcgagatgacggatttgcagaatgtcaccttaaagtatgtgtatcatgtgttgaaataagcgacttcagaaacaacaaggctatcgttcaaccacagctctccaacactcctcctcatcacacaacctccgaaccgcatatctgccaccgagctcttctgtcctctaaactccttctggcaccgaactcctcctagctgctgaactcctcctagcctcgagctcctcctggtcagttgcaacatcgtcctcttggtcaattgcaccgtcctccaaacttccgacttcctccaacacttccgagctcgtcctctccgaacagccagcatccgcaccttcagcctcgttctcagcatcttgacttctcatccggtccagactccacctcccgtccaggctctacctcctcagcgagattctgcgtccaggtgtttgaaaacaaaaagtacaagaacatcaaggctaccttccaaccgcagcctactgactgatatcgctaccggctggtagtaaggagtgtatcgaaaagtagtcgcaaactttcaaaacagtctcaaaaataataggttgaacctacaaacaactttttgatcagaaatgctttacaatgtatttaaaaatgatgatgtggcgatattatttcaataaagtggcattttgcatgataattttaaaaataattaacagatgtcgatgaaaatcttgcacacctctgaaaaaattgatatgttaataaatgtgtaaaatttttagaaaaaatgatttttgtttatgctaatatattctgtgacacaactctcatgacatagtgtaaaaaatattttgaaaaattcattaacaagcatttgagagcaaatacaaaaatcgaaaaaagtcgatttttaaggacctcgttttttgattttttcattctacacgttaatggtaatatcgagcgattgtaatgaataaaaaattgttttttgattggaaaagtttctttgcatatttatgaagtaatgtaagcaaaaaatgttattctatataattgccgctgtatatgacagagcttcaaaagttgattaaacaaaagtgactttctaaaaccgaccttgttccaataattgagcttttttagagcaataatttatttttttgaatttctttttacgtgctgtgtgaattaaacatattttccaatataataaacttttcatcctattttgtttgacatacattttgttcaatacaaatcatcgaatcttcagaagacacttcaaaaatgtaattttgtgcaagattttattttccgtgctttataaaccctgttgtgtttatattaagactgcatattattcaatatttttttagctgctacaatatttcatgacatgatgaagatttgcgtgaaaaaagcttttaaaaagatgaactatgctctgagatataccgttttgaatgtttgcaactacttttcgatacactccttagctggctagctcctctcttttataccatatctgggtatcaacatattcgactacctttacaattcttacccaatacatcttatcaattttatccgctacgcgttacctctacaattcttacccatagacatctccactgcaggatgtgtggtgtatcagctctccaacactcctcctcatcacacaacctcccagctcatctgccaccgagctcatactgttctccaagctccttctagcaccgaactactcctagctgctgaactcctcctggtcagttgcaacatcgtcctcttggttaactgcaccgtcctccaaacttccgagttcctccaacacttcctagctcgtccgcaccttcagcctcgttctcagcatcttgacttcacctccggtccagactccacctctcgtccaggctctacccccttagcgagatgcaaaatcactcaatcaactcaaaccgtaaaaaaatgattcactcgcaaaacccgtcaaaaactcgtgaaacccgaatgtggttgtttacgttagaaaggattactataattttaccagactaacaagaaattattgccgtgtgtgagtaaactgtgggaatacgagacggtcaaaaaagtgagccaactcatccatggtttttggactgctgagttgcgtgatttacaattcacgcatgaaaaatctcaagcgtgagttatgagaaattgagtttttcacaacactgcctgtggcatcgaaggttcgggcagcggaacagcgaagcaatctcgaaaacgtacgtgaaaaattggttccgaactaagaatgaggaaatgtgacattcagtgcgtttgtggtattttctgaaaggaagatgagtcgcctaccgtttccaaagaaagaatcaggctatacagtgatttatttgttgaaagcaaagtcggacactgaactgaagattcgggaacattgtgccatgatgaagaaccagtttaggcgtgctctgagggttattcgtaccgacggagaacggtatcattcatcagcaaaatgatccgtattcgccacagcagaacgggaaggcggaacgtaaaaatcggtatgaagtggagatggtaagaagcttgttggtggaatcgggttttgacaagaggtactggagagaagcgatttgcactgcaaactacttgcagaatcggctaccaacttctgctgtcaagaagactccgcacgagctgccgtcgtactcttattcgagaacttttgaatctgaggcatacattcatgtgccaaaagagaaatgtatgaagctgaacaagaaggcgaaaacgatgttttttgacggatacgaagaaggaaggaaagcttaccgttttctggatccggaaaaaggattggattacgatcagctgagatgccaaattttttgaaactggtgtcttcaagtaagaacgtgcggccgaatcggaacagtccacgccggttcaataagcatactcgttggagatgaaagcatttgccgaagaaacggaagacaaggtggtgttgtttctcggttcggaaactcgcaatccgggatcattgactgaagctgtggaaaacccgaagtacgaagaagaactggagaactcggatcccagcccaaaaattgcacgaaggcattgcaccgagaagactaatcgaagagatttgtgctgcctatgatgtgtcatttcaggatccgacggagccatccggcttcaaggaagcaatgaccggtgaaaagtgtgcagaatggaggcgtgccatggaagctcaaaaggaatctcatcaggtgaaaggtactttagatctgatcgtcggaaactcgttgtatgtcgttgggtatataagttgatacggaatgctgccggtgatgtggtaaaatataaggctcgactcagggtttcagacaagacttagactaggtgtttgcccctgttagcaagcaaacaacgctgaggaccctgctggccgtcgcaagcaagaagcaagtgattcttaagcatgtcgacgtgaagacggcgtacctgtttggtgagcttgaagaagagctgtacatgaagcaaccgactgggtttgaaatcaaaggctagaaagcattggtctgtcgcttaaggaggagcatacgggctaaagcagtcggcccggtgctggaaccactagctgcgttccgtcctcctggagctaggggtcgagcagagcacagcggaaccatacttctatacgaaggctgtcaatggaaagcgaggctgaaataaagaaaattcatgaagctctgaaggagcagtttgagatgacggatcttggcaatctgaacttcttcttgggaccggagatcaccaggacggaaggaaactacggcgtctcccttgaaggctacatcggtcgtgtcgctgagcgattaggcttcgtgacgccaaggaggcggaaacgccaatggaggaaggattcacgaagggcaagtcggaatctccacttctgaagatccaacgaagtataggagcctggtcggagttcaactgtacattgtggtttgtgccaggccagatacagcagtgagcgcttcaattctgggcaggagtggtccgctacttgaaagcgaccaaagactggcgtctggtgatgccaaaacaaggaaatcgacgaccggcaacatcttcttgttcgctgatgtaacttgggcgagtcatttgcagagctgcgtaactttgccgtcaatggagtcagagtgcgttactctaactgaagcaagtcaggaggcagtgtggcttaggaaactgttcgaagtttttggcgaatcaaaattggaacctgaaggcaaccaagtcggcgatcgaagcacatagaaacccaagaggcctacgtgaatgaattgtgcgaccaaaggatactggtgtaccgtcccaatgaagagatggtagctgacacacttaccaaaccttgataatttcttagaaagtttgatgtacatttacccaagatcacaatcaggatttttgacaaagttctctgtagggatatttcaagacccaaaaaagtaaaaaatctcactaaaagacttactttcaacactgaactaaagctttttctcaacgtcttatacaaatctatcagactctaattgcaacaatcagatgaatttgtgttttttcctagatataagcacgttactttgttagcaccgacatattgttacgaaaatccaccacaatcaccttaagaaatatgccgaataagtttacacaatattatcttgagatacctagaggtagggtgaattgatcgtttatacgaacaatgaaaacgaaattttaccaaattattaaaatgataactaaatcaatagaacaatacataaaactactgcgaaaggtttccaaaaacaaaaagttatgttactcactcagtttgagttcactaaatttgaatcaaatctactgatagagtatgggcccataactagttgaaatcgaattaaaaatcatttcaaaagaatcttccatcacaattttactgtttaacattccagtgtttctctaaattacctttaattaaaaatattttctcattcgattccaggtgtgaatagtccccaaactgaagcgcatagttcaagaaaaaaatccgtaccataattcgtaaacacataacggagcagccagcagtcgtacagccaacgggtctgtatgcgattgaaacactttttaaaaagtgcaccactattaccgcacagttgacacaatgacgttaccatttcatctcagcgattaaaattttaattccttacattacacaactgtgaaacagacgaaccgcatgtaatagtcgcagcaaccgtgtggaagtacagaataaaaaaaaacaaaactcgtaaccatagtaatagtcgacagtccttgacaaccgaaaattaaatagaaaaacagaaactgacagaaattcgcccgatgaatctaagcaaatgcatcacaaatcaaactttatctggaaccagaaacgaacagatcgcgactcctgcgtgaccctaggggacatgtttaaaaccttcaaatcaaatagaatgtgtataccgatggaagcaacatccaaaccgcaaacaaacaaaacagaaaacgtaaaacaaaggatctaaaactaagtgttcaataaatgttaattcaagctgttaacgaattctccttaaataacaaaaaaaaaaacaagagcaaacacaaataactcttttttctcgtgtaagaatcatctaatttaatttaaacctactttttttcggaacattagtgcaatatttaaggcaaacattaccaccaatccaaccaacctgcagcgatccatgtcatctcatgtcggaatcatctcaccccatatgcgcacccaaagaacaaacgcaaacaaaaaaaaaatgtatcggaatccaatccaagcgagttttacgcaccccctttttactcaattactgtt

SEQ ID NO: 197 - DNA, 20290 bp, Aedes aegypti
gtattttgaattttctgggaggctaatacagtgcttatgaaaatataaaaaatttgttttacataaatttttcaaaagtcataaaaaacattcctattatgcgtgtgatgagccaaggttcaagccaaaaataaaatcattttgatctccgagctatacaaagatacatgaaactccaaggtgtaccccgtctaaaggcggggttaatagaattgacttatctgcccaagtaaccatggagcattatatcattgccgtaagcctaccattaaagtagctaaaatgttcacatatacagttgtgttgaactaatgcaagaccgttgataaagctatcaagcaatttgtaaagtaatgttagtgcagcagcgcaatttataaattcgaaaaaagcaagtgaattgaaatttatcgaataatagcaatgttgttgatatgcagtagaatatgtgcaatgttataatgcttgacatctgatcagattccattgtgactataatgaaggcaaaccgtaaaagttgccgaaattgcagcattttgttgatttgcaggaaggtacagattaagcaagagtaatttaacaacattaaatttaaaaaaagtgtaataattattgtatggattaatttattttgtagacaacttgaatagaatttttagtagtacctcaattcaaaaaaatgaatatttaggtgaacatcaattctcctcggaaatctagtctatccagattgtattatactacaataattttatataggactaggcctgctacatacatgaatcgtatgcagagaggacattaatgcaatagtagtatagaacgagctcaccaatgatttcggaagcagtcaatatttagtaaaaatgtacgcagagcaaagtaaacgaaattttcttttatgatcaaataattactttctctaagaaggaaacggaggttcaaaattgggcaaaaaaaaaaaatctttcggtgttataaactaatcccaaataataggaatgcagatggctaaggcctccgccataccatttcctcatttctattttcaaatcgctagctgttacttttcgacaatataaacattgcattcacggttttcgtggaattcatttttccaaattgtttacaagaacataccgcgtattccgttagctgcggcgctacacgtttctgaagtgcaaggttttatcctccatccccagtcgctcgctctcgctgcaccacaactgtagtacttgtacccatccacttctgcaaccgtacgcgcgaaatgaaaataaactaatctatatttgcgcacttcgttgcatacggtcagctcagtcagaccggctaagccatccacgcgaaagagtctagattttctcagtgcactgtaatccacctaactatcgaacactgcccaggcctcgtccacggtcaggttcaagcgacgatctccggcacgtcttctgtgcccttagccggtaaagatcgatagatcatagaggatcgaacagggcgtcgtgtcacgtgtctgcgggcgtcagcggaaaatcaagtgaactggatagcactgcattggatccggatcgccctggcccatcaggatgccctattttgcgatgcaaagaaggcccattctactgaagtgcgcgcttcgtgtttagagcaaattatgtaaccagagcgttgattgtttcgtttttttcttttctctctttgcagaatctgtttgacgacgtgcaaaatctgcatcctggtgttcgtgatcatcttcattgtgttgccactgatattcaaattctcgtttgccctgcagaagagcatcctgtttctgacgtttagtaagaataaattattttcgaacatgtgcaaatttctgatttcgattttcatttttagtctcctatccgccaaatcttgatctcaaacgtccggagaagagcggactgtacgcgacgcgtaactttttcgtcacctaccgggaccaagaagaggacatcgatgtggatgtcgcggtgtggcacgtgcttcccaatgatctggttcgccggttcgccaaagaactgcaaattgatgaggtaagggttttagggcaataagaagtgctctagtattgagcagtgcagtgcttaattaccacttgaaagccattctgttgcaagcgattctcgttctctggagcacatatgagtggcactgcatttacattagggtggttcaaattacaaaaaaggatgaaactttaaatttaaaaaatctcttaaacctttttatggtcttttagatagaaaagagtcctgacaagttttttatggtcttttagatagaaaagagtcctgacaagttcaaccattcgattgaataattaactctatttccgacttttttcaatgctggaacaaaagttgttagatttcacttaaatttatcgcaatcgcaaaaaaaaagttttttttgtggtgcatctacactgacctgtttttttatcaatagttgtagtattgaaccatcaagttgagtactcaaatgagcccataacaggtttacaccattgaattgaattggtttatgcaaacatgaattcgtcggacagtgagggtgctctaaagacaccatgaccgttaaatggattaaaagtggcccaaagacgtacgtaagtaatcaaggcagacggtactttatacataaatttaataatgacttgccctcatttggacttattgaaattcgaaaaataaaacgatcagtctaaagttaaacacgttcgactgatggagttctgaaatgtattatgattttacatgcatttatttatttacatgatttatttgtggttacttaaatttacattgaaaactcagattatagagaaatgtaggtcgggccaaattctggagtttgaaaattgttttaaagatgattccatatcattacgaagctatacatcatcggtatttcgttatgcatgtaaactgtcgtgaatcgcaagtcagacccatctgcattttcgtcaaaattaagttgagttcagttttcaacatattttccaatgctctttcagctgcactaataagataacaagatttgttcagaaaaataggaaaaaaacagcaagtcaaattgttccataatgaaaagtaaccgcatatcagtcccactacagatttccacaccgtgtaacacaaaactgaaccgtgttttgataatctttatttttcggacagatatcatagtgaaaagcaaattatgaaagttttaccaagatttgaacatgttccaattctctggaattttttgaataatcgtatggaaaacgagtttgaaaacttcacagcccattttctcaatgcctacttttcacagatgggactgacttacgattcacggcagtaaagtgtgtagaaaacaagttttatctagttttcatataagttgcgtcacgttttctgattaccgacagtttacataaatgttaaactatgtaaaatgaaaaacacagttcgtttgaaatcaatcgctgaacagaattgatataaaggcaatataattttcatacacaaacatttattgacgatctcgccaaggacgaaaagccactatttgtttaaaaatcaacatcaagcatagcatagcatagactgactgtatgtacatgttgctactccgtgattgatcggacatgataagaactgcacttcgatccaaataaataaaagatggtacctactttccgcttgttctcgaattgcatggctcgaagaataagtgtccacttaatacactacacgttaatgtttccagtgggcctttgaagccatttgaagaaagcaccacgtttctcacgtaaagtttttcggcctaaagcgggaattgaaacccacttcttagcacgatgcgcgtaaccaaggcagtgacactaagcgtacggctacgaagcccacgcactttgagattatatgtttgtgctcacattgaagtactatggcatttggaatattattcaatatttttcatagtaatttccatacaaaccttcatcgtctttgggccatttttaaatctccaccgaaagtgctgaaactttgacagaactctatttccaccagaagatttgtaagcaagatatgatggattagttttcaaacttttttgtaatttgaaccaccctgatgcacatgtttccccttgggagatcgtcatcgtgttgcgaattcgaatgttgagcgcaaatagagcagcaacacatgtgcaaaataatgtttaaaagcgaaatttgacacacagagaaaattggagcacgaccggtctcgtgcatgacattgcactgtgctataaataacgaaaatattaccgaagtcgtgtagacgttaaattgtgaataatggaagatgacgttctaggcattccttgctttaatttttgatcaatgaacagttctgggggtgtgttggttccggtaatcatatgaagatttcgattgattcgttcaaatcacgtttacttttttaatttatttattaatacctatcattcttcacattgctttcatttttatctcaatttctgcaaatccacagggagcatttctagcgagttctctgagaaatttgatgtagggggagatcccccagtgccggacagcacccaataccggacaaagtcgaaaaattgagaaatcatggtccaatcaagatggtgtattagtagaaaatgaagctattatggagactaatgtttgcgtagaataatcctgcatatccttgaattgtgcatgcctttttaaaaaaggacaaaagtttgaaaattttaaaaaaattgacgtgtcgccttaattttgagcctatttagtaattatttcgaatatgaaaaaataatttagatcacgcaagcgtgttcgaacataatccacatttgatagtatgaatgtattttgtaccataattgaactaaatatggacaaattacaattttggttgagcaactcctatcccccagtttcggacaacttgatttgttacatgatatctttgtaattattgcaccagtctctcaaaatacattaatttttcatggactgcttcgatcatggtatcaaacatgcaataaaattaagaagaatgtacattcagaacagcatcgtaagatgtgttatttttcatcatatatgaaagaggtttttgatggacatcttgcaaactaagaaaaactcaaattgttctattaaatgttgcaaatgcattgaattggcaattatatactattcatatagtaaacacattcaatgatgtacaaattcacataatttgaggcatttccagaatgtgtccggtattgggtgccacctttcaagatcgatcaatttggtactaaaatacatcatcaaaatgcaatgtcaaaattcatatttatatcttcaaatttatttttgtacactataaaaatgataatatttatcataaatgggtaacacgagcacatgaaaccaatatttttcgatatattaatttagtggcttaagtgtccggtactgggggatctccccctagttagttgtcaaattttggcagtacttctttgttcgtaatttttaacaaactcgtagaagatcctgataaatgttgttgttgtttattgaaatttttggataaatatctactgggatcagttcaagtgatgcttacagaggcttttcagtactttcggtcaaaaattaaaataagaagtttgacaatactaggtattggaatagaaggaagaaatacacaaaagcgaaatttctgatgaagtaccgtaatccgaggtcaaattgatcactgtgttgaatttgatcaggtttgtaccaaatagaaaatgcttaaaacaatggagtgtctcgttgacatcacaaatattctgtaatcgccagtaaatagatatcgtaactagttttgccagaaatattcatagtttttgaaggtgtaaagcaatactggtggaaaaatcattaccgtaagtcgggatgtagttgatcagtgaggtgaagatgacgatctctccttaacccatgtgtagagttttgagttttgattcagattcagtggtttacaattgagtaacaagaatatttttttatttttggaatcctatcacagtagcagtttttggggcatgtgtgccaccttaagcaatttgttctctaaccatgtcataagcttatcaaatccgccaatttagtattatgatgtaaattttatattttctcataaccattgtgtcatttaaaatggaaaggaattgtaaaagtattagttttgtactgaggggtgcagtctcgaacattttggtaattcaatttgaacacaaatttttccaccagtgctaacctgttttgcagcttctctaatatcatccaatataaagtattttttaacactatggggtaagtgtgccaccgattgaatatcaagttgatacgttcataactatttcattattttatttttatattacttaataaggaaagtcttggtggcaatttaggacatatttcaaagcttaccgtcataaggagctgctttataacaagggttatcacgtgttaaactatacattagtgaattcgatagtatttaaaaagttcaatgcttgaaactgttatttttatctctatttcatacaaaacggaccattctattacgacgtatataatactcgactagatcaacactaaaaattacggtaacaatttgttatttcaaaatgctgcttgcatgttgattacgaaattttgttcagggtatttattttaatttactaattagaacaactttgttcctgcctacaaggatatatatgcataggtggtgcgtaagaattcccttgacaaaaaaagctcaatatatcaaaaaactagttaataaggagtgtatcaaaaagtagtcgcaaacattcaaaacagtctctaaaatattgggctgcacctagaaaccactttttgatcagaaatgctttacaatgcatttaaaaattatgatgcggtgatattgtttcaataaagtggcattttgtatgataattttgcaaattactaacagatatcgatgaaaatcttacacatctcaaaaaattgatatgttaataaatgtgttaaattttaagaaaaaatggtttttgtttatgctagtatattctgtgccacaactctcatgacacagtgtaaaaaatattttgaaaagtacattaacaagcattttagagcataaacaaaaatcgaaaaaaggcgatttttaaggacctcgttttttttcactctacaagttaatggtagtatcgaacgaaaaaaatattttttgattggaaatattaatgaagtaacgtaagcaaaaaatggtactctatataattaccactgtatatgacagagcttcaaaagttgattatacaaaagtgactttctaaaaccgaccttattccaatatttgagctttctcggagcaataatttattttttttgaaatccgttttacgtgctgtgtgaagtaaacatattttccgatagaataagcttctcatcctattttgtttgatataaattttgttcaatacaaatcatcgaagcttaagaagacacttcaaaaatgtaattttgtgcaagattttattttctatgctttgtaaaccttgttgtatttatattaagactacatattaatcaatatttttttagttgattcaatatttgatgaaatgatggaaatttgcgtgaaaaaatctctgagatataccgctttgaatgtttgcgaatacttttcgatacactctaccttataccttataaaatacttgaatcttgaaatattttgcttttcgatcataaaggacagataattcccttcacggcaaaacacactaccgatacctcatcctggttcactattatcggtttgttgctaaaatttacatttttataagtttctctccaacggatatttattgccaaacacgtggcacacttgcccttaaaagtacaaaaagtataaaatttcgtgtgtgaaactgtgaaattaaattaattaactcattacgcgtgggaaagatggacaagttatgggtgaaattttgaaaaaaaaaaaatcctcgtgcttggctaggatttgaacccaggactcttgtatgctagacgagcgctttaccaactaagctaccgagccacttggtgacccaataactgagttggttacaagtttagaattcaaatccctacagaccatgcggacccctttcataacccatatgcatccatctcatggacactacacacgcggaaagagcgagtgcgatttatttagcgttgaaactgtttgcctatagttgttgtggaagcgatgcttaatttgtttttagttaaaactagcttaaacgtgttttattaattttgtgaatattttacagttatcagttaacttctcaaaaaatgatgcaacagttgttttaaagtgcgttgaatttgacactggacaagctatctgttgatgaatagtatattatttattcttattaagtacacacattctttcaacaaataagtgacagaactttcataaaatttaaaactgaatgtttggctattatcaaaaaataaatccattcttccacaaatttgagcaagttgaatgaatttattattttattctaggaagtaggaattctttatcagtatagttagcaagctgcttgtggaacagagtgactattaatcgtgactgggcgactcatgatagtgtgaccagtgaactattgaacagacttctatacatttgaccgcatttttttttgtaaagaatgtatatagtttgactgaaagtagtaatttgatgagagattccaataattattttataacctgaatatttattaaacacatttaacctataacgacaagttttagctactgtcaattgatgttttgtcatcacttctaagaccagcttaatattaaaatatcactgtgatgacattggaaaataatataatttgcactgttcaaaacattgttttatatttggactttacgttacagttctttcaattttcttcgtattttttactttcgacattttggcattcgatgttttggcattcgacgttttatctttcgacgttttgtcacccaacattaaggccaaatcttgatttttttcatatttttttcttggcaaattaaaacgagtacaattatagacaatatgatctatattatcatacgattcaccattttcacaaatattagagtccttgatatttatgcggtataaatgactgttacatatatttatttttatttttattagacataagtctaggtccgcatggtctaaacaaataaaattacggctgatcgataattgatgaaaccaagggaaacacttcaccttgtgacaaatggaataacaataacgtcttttatcacttgtattcaaagcgatttgagatttgatttagaattgtgtttcaatttcgtaaagtattctgatagaaaaaatagaacgattataaattgaggtaattttctgattcagcttacccaaattcagtataggtatacagttgacagttgcccttcgtgcgcgaacgacgtctttttcatagctcaagctatcgcgattactgtgcaacacaagatgtcttcatacaggaagaacactcttgtagtggacttcagtgtcttgccgaagcgtcccccaacagatcaggttgaggagttcctccaggatttcgttaagctcgatatggccgatgtacgggaccttcaactgcacactcttcgaaattgtgtatacattgagatgtacaacgctggtttaccctctcgcctggcaaagcagcaccatctacgatattggctcgagcataacggagctgttatcatattccaatttacgtggatggtcctacaacaaccataaggatccacgacttatcaccgcagatgtccaatactaccatcaccgactacctaaagcagtacggcacagttgtctctattagtaacgaagtgtggaaaatctatttcgccggagtgccgaatggggtaagagtggtacgcatgaagatgaagaagccagtgccgtcccacattacaatcgaaaatcaatcgtctctcgttacgtatccaaaaaacgagaaacaaaaaacatcaaccgaacacgacaaaaaagatgatcaagaccaaacgtcccgctcggctgctattaaccacatgaagcccgataacccaccaacaacactatcgcatgacatggacgatgaggacgacgacgacgataacgatagtacgaccaacgatgatctgcaaactatcacgaagcggcgactgtcaacccgaacatctagcgatgaaaataatcgaacacactgtgatcgtgagggtcaagagatagaagaaggaaaagatcgatgctagttagcggattctggatggagagttacccgttctagaaaatataagagaacggaaaacgcaaatgaaataggtagaataacaaattaactaattgtattattgttgtactgtacttgaattgtaatttatgatgaacttcaatccgacacgaatacaccattaaggtgtaaagtgtcgtaaataaaaaaaataaaaaagtataggtataagaaaatttataattttcaaacatgttttgttacatgatggtattctgtgataatcgtgttaaaaatgatgtgggatttcctatgatcagtactacgtcttcaaatataatccaggaataatttaaaaaatccggctcgtaatggtaagagtgatgtaccgtaatccggggtatcattgatcagcggggtaacattgatcgggatgactcatcatgtaaaacgtttgtgtcatcatttattgatatttcgaaagcatgaatggcttttctccttcttatactcatgagctgataaaaaatagttttttttttgcgaaaattgggtttactacacgcgtaaatttgacaacttttcgaaacaacgatttcaatggttaaggatgacactacagaggattcatatctcacataagttttgcaagcgatatgagcaaagaaaatgcggttcttacttaaaatggcatcgtcgaaaacgattccgttgtcaaaactttcataagtatatccaatcaggcaacattaacgaattattgttaagaatgtagaatttccttaggaaattgcctacctttaggcatattccgcggttcaaggtgtttttctctaatttttaaataactcaaacagtaaaagtaagcgtttgtccttcatattcggcttcagaagccatgattttagtaagtgacgacatttttagtattaccaaacattgtttacataggtgatcaatgttatcgcatatcaccgaaatcgaacaaccctacaacattttttaaccaagcgtaaatttttcagaaaacaaaatacagtatatagttacgagctatgtgggacagtacttgtttgaaaaatataaaacttgcaacatttgcattttctaatgaaacacttaagcaatatccaacaaactgaccaatgttatcccggattacggtaccgtaattgatcattttttttgaatatttcttaaatattttgtttgaaaatgcaaatcttgaaaatttcatatttttaaaacaagtactgccaaccatagctcgtgactatatactgcattttgtttttttaaatgtttaagcatgtttaaaaaaatgttttaagtgatttttttatttagctgatatggggtaacattgatcacctgtgtaaacaacgttcggtaatattgaaaatatcgttacttacttaaatcacggcccccgaagccgaatatgaaggccaaacgcttacaagtcatttaccttttgagttattttaaaattaaaaacacttcgaaccacggaatacgccttaaggtaggcaatttcctaagggaatcctatattttttacagtaattcgttaatgttgcctaattgagcatacttatgaaaattttgacaacggaatcgttttcggcgatgtcgtttttagtaagaaccgcattttccttggtcatatcgtttgaagaacttatgtgagacatgaatcttcggtagtgtcatccttacccattcaaatcattgtttcgaaaagttaacaaatctacgcatgaattaaacgcaattttcgcaaaaatcctcacttacattagcttatgaatataagaaagagaatcaccattcgtaatttggaaatgttccatcaataaatgatggtacgaactttttacgagatgattcattccgatcaatgttaccccgctgatcaatgataccccggattacggtacatgatttttaaaaaatccttctcaaaatttcattagaaatccaaaaaccattgtttcagaatcccacttatttttgtttgaaattcttgcccagggtttttttttgggaattgtctcaaggattgcttagaaaatctttcccaagattcattttcaaacactgtaatgcaatctgataaactttaattttgacaaaaattgaactaagttcatgaaaaactcttgtttagaattatatgagaactatgtcccttttcggtaccagttctgactctgtgaaatcctgtgaacgattttgtgaaaatacaactcaacattctgatagaacatgttcatgtttccggtgaaattcatgtccagagttttataagaatccacactttaaatcaatcaaattgttttatttttagcaacaaattttgttcaagattgatggaatttcagtcaaatctatcaaacagtaaagcaagttatgcgacagagtttttcgtacttgattctcataaaattatctccactgaaaattgaacttttgaatgagctaaaacattcccaacatgccataggcttctcctatgtgtgggctagtactgctggcgacatcctagtaaggttcaacaagtcttcaaagcccatcgtcatcaggactcgagcagactttcataaactgacttcaaatcagcaatcaaagcagttgtgaaaatgtacgacatggccatggataacattttaaaggaaagtaacatttttgtcgagccaccaattcagcgatcattttttgcacgtgaatcctgctttaatatgctacagatcaatattcgcggcatgaataatattgaaaaacttgattcattagccatatttatcgataacttgggtactcctgtggatatcctgataatttgcgaaacgtgcatcaaacaagacaggtcgagtttctacaatatgaatggattctcctctatacactcttgtcgtactcaatctgctggaggcttggctgtttatgtaaggaacggcattggctacgatatcataagcaactctactatagatggttatcaccttatcaacctacatataccaatggacaattccgtttgttctattcacggtatacatcgtcctccagattttgattttgttcgtttccgaaacctcctggaagaaattttggcttcgtcgaacctttccaaaccaatatttatctttggtgacatgaatgtggcaatcaaccgcgacagacgagacaaggaagaatacatggaccttctacaatcatacggcatgatagttacaaacactaacattacacgacctgagagtgacattatcttggatcattctattgcacgaattgatgacatcactagaatcactaattacaccattagctgtgaacttagcgaccacaactatgttctaacatctttgaaaacatttgttgccagtaaccgtatgcgaacattgacgaagactatcattaagtccgaagttgtcgatagaaaattcaatgagttcatgacagtctacgattgggccaatgcgaatcctaatgaaaggctggtaaaaattgcagaaaagtatattgagcttcggaacgcgaatacaactaccaaatctatgcacgttaaactgaaaaaagagggatgtccatggtttaattatgacatgaaagtcctttgtcatgcaagggatactgcgctgaagagatggaagagaaaccgtacgaatgatcatctcgccgaagttctgagattagccaataaaaaacttgtggcagcaaagcggaaagccaaaaaacattattatggtcaattttttaatgccggcaatcccaaagaactttggaatcgcatcaacggtctgcttcctaacaagttgctaaggagttacgtgcagaataggaaacaagctgtcattgttaatggatgtcggagtagtgaacttagtattgaaattggggtaccccagggaagcaacctcggaccgctgttgtttcttatttatgttaacgatctgtgtaacttacggcttaacggtgttcctagactatttgctgatgatacagttctctcttatactgggcggactcctcaagaaatagttgataagatgagagaggatcttcttattgtaagtgaatacctagaaaacaatctgctatcactaaatgttgcgaaaactaaatttatgataataagaggaccacgcactattctctcggaacatacaggtatcatgtttaagaacgaggagattgaagaagttgaatgtttcaaacatttaggtatcattctcgattgtaacttgtcatggaaaaatcacatcaaacatctagtccaaacttgtgctccgatttgtggcatgcttaggaaactatcctacttccttcctagacacgttttattaaaaatatattatgcttttataaatagtcgttaccaatatgcatcatgtgtatgggcctctgtaggtgtcaatcagttaaaagcattgcaggtgcaacaaaacaggtgcctaaaagccatatatcgccttccattctacatcctacgataaatctatatgattctttcaaccacagtatagttccaatcggtgctttacatgcatatcaaacctcaattgtaatccatagaattatttgtatccaagatatacatcacaattttgagttacagaatgtatcacatcagtacgaaacccggaatttggaccgtatagttgcctcgaattttgcgtctgagataggtagaagaagattttcgtccattggacctcgcatttataacaatttgcctagtagcgtaaaaaactgtgaatttattacaacattcaagaagaatttgaaaaagtatgtgcttgatcatctaggtagatatctttaagtagacgaattatatcaattagcatgtaacaattattataacaacaacaacaacactctcggtacttttgagactttttcgaggagctttgagttcattaaagtcttaaaagtgcagtgccgctatgtattgcaatagttatgcttaataaatttgaatttgaatttgaaagttaaaattgacctaataatgtgaaacttgatctttctgaatcagtcataaaagatggaaaatttaagagaatcttaagaaataatataaagagtcacttaaatgaatttcttcttctttcctggcgtttcgtctcaaactgggaaagagcatctcggtttagtgttcttgcgcacttccacagttaactgagagctttctttgccaattgacaatttttgcaagtgcatatcgtatggcaagcacaaagataatctatgcgctgggaagtcgaaaatcctcaacaaaagatcctcgacctgtgggattcgaacccacgaccctcagcttagtgttgccttggtatgttctaatttcaagttcgcaacggaccagatatgacacgaatccttaaactttatgcgggccgcacaaattgaacccgcggtccgtacgtgtgacagccttgacctagaattagtaatgatgaaaacgaaacaaactaagcgtccctttttatcgtttttttttttctctatccagcctactctatccaacatgaccgccccggaggatgtccgagagaaggtggacgcaatagctaccaaagattcgtcgcaatatcgggaaatcgagcgaattctacaccgcccgaacctgaacctggacgatagtgccacccagaaagacctgttcgaggagaccctacgggccaccaccaatgatattgtactttatctccacgggaacactgcctcacggggggcttcacatcgagtggatttgtataaactgctgcgcagcttgaattaccacgtggtgaccctagattaccgagggtacggtgattcggccaacatctccccaactgagcggggagtggtgtacgatgccctggccgtatatcagtatattaccagtattagtaagaatccagtttacctgtggggccattcgctggggacaggtgtggccacacatttgctgtccctgttgactgacatgagcttgccaggaccgaaagcagtcgttttggaaagccccttcaacaatatccgggaggaaatttgtgctcatccgttctctaaggtaacatcgattttgaaaccttggtattacgaaaaattatcgttttattcgttttagttgtatcgacatcttccctggtttgattacaccatttcgagtcccatgtatgccaatgagttgcgtttcgagtcggatcagcacattgccgagttcaggcagccggtgttgattctgcatgccgaggatgatcacgtcgttccgttcaacctaggttataaggtgagctcaatatctgaactcgaatgtgctagagcatttactatttggataaatttgaaaatcatgcgatgctataatgaaactaacgcttcgcccatttttccctttctgcagctctaccgcaccgccctggacactcgcggaaaatcgtggggccccatcgagttccatcggttcgagaagaccagccactacggccaccggtacatctgccgggcaccgaacttgccggagattgtgatccacttcttccgcacgtaccgcaacgaacagtactgaattgagcagcgctgttgcccaaccgaggtgagtttcagggcgccaaacaccaatctgctgcttcccataggggagagggaggagtgaaatacgcagttgtgattctttttatcaaaatgataataattattagtaggagactattcagctctgtaagttggagcgcaataggccaggacaggatagatttttccttaattgaagaaacggatctttttggatagattttacctgctagagtatctagaaaaaacgtaaaataaagcaaacatgttggtgattaagtaaattgagctactctctcagtgaatcgtgaattagaacgtagttacctaattcgagactcaacgtttgattaaagtagcggtagagatgaacatttttagataggatttatgcatgatatccttaccaattatggcaagcaattttcccatttgagggtagaagaataaaatttaccttagagtacagtcgaaaaggattacgttgattttgatgacagccatacttacacaggcacaagctataattatttgtgcatggattttttttttatctatcggaacacaaacaaaagtttaaacgaagggaagttgttcggatcatattatctgcacgtaggtcatttaagcattcattttccatttattcgctttttaaccatttttagcagcaaattgattcttaactaatgttgataataacaatactcgtttctgattatcggttcaaaaaatactgaaaaaaataccgcaaacattttgtttaatcaaatttttgcttcctactcaaattgaccgaatttacttcgccttccaaatgactagaccatattttgttctgttgttcttacttggccaagagaaaactaatcgcccttaatacatagatagttatagcgctaccagagaatatctcgatcgaaacgagagaagaaaccgcttagaattgtaaaatttaagattggcgacagctcgtgtcccaccgctaaacttagttataaaactgatatgtcactatttacacaaaagagtcttacgtcgtaactattatttcgcttggaagcagctttcattgttcgagtttatcaccttaggttttcctccgccttcgcgtcgtccatacgatccgtcacttgcgtcgttttgagtattttactggagattgttcttacactctaaatatgtgtttgatgtagaaatgtatcggactgtggacggctttgggtgaagcaaagccgattccgggtgtccgatcgggagacaaatgcatcgtttctggttttggagctgattttttatacatacgaattaatgagtttaaatgtagtttctatggtttgatgaagacgtaatgcaccacttggattatgttatgttcaaaagcttcttctgcgtgttcgattatcgtgataaatgacggagtaacttttcataaaagttgaaaatatggttgattttggattcacttcttatcgctcataagtataatgacaaaagatttttttagatgatagacttgggatagctacgagacgagatcgaataaagagttttcatatgtctaaagttttctatgcgttgcaacaggaagcgtaaggcaagaatgggaaacgaattggttcaacaatcggttgcgcttggtactaggtatgccgaaaagcggttcctctactgacatttagcggtatatgtacgttatgtgaagtatgacttatacgctttgagagtttcatttgattgacgaaagatatttacttgtgtattgattggaatattctatacattttgtttgatcatacctacagtataagataatgtctcatctatttgttttacgtgtcttggcagtcgtttatagttgtgtgatttgatgtatttttgggacttttatcgtgttttttaggatgtctatcacagaaatggatccgattatttgatgaaggtttgcaaccatagtctaaaaacatgagatagtttaaatgtacaaaattaatacttgtcatgatgtttatattggtaataagttatagcaagcaatttaactatttatgtcgaaaaagagcaaaaaaggttgggctggcctgctatagacagacccggtgattacaatttcaacgaggaatttatgatgacttttagttttagatcgaagttgaaaagcgttgtaagtcattccgtttggcggtatatcattttgctgtatgtgctcttgaagaaatgattgcgttccatacataagagcaaatacagggctggtagcgacccaaaagtaaaataatacttactttagtaactaaaatgattaaaatggtgatcaaaaatgacttaaaactacaatcatttttaactaatgaaaaaaaaaacattctttgaaacgaaaatgcgtttccatcatagctctccgagtgaaattttttgaaatttatatgacgatcttatttgtaaaaatttataattttcggacaaattcttggagcagtttggggtaacaatttgtatagaactgtcactggaatctctgtcgattttttttagaagctctgatgctatctctggcagaatccagcattcaaaaacaagcaaaacatcacagaatcacagaaggttcctggttgttatctggcacaattctaaatttctgcatttatttctaacacaattacttaactaatattttagtcaaccattactgccgtaaatcgcaagtcagtcccatctgcatttctgtcaaaattgagttgagttcaaatgttccaatgttccaatgctctttctactgcactaacgagttaatttgatttgttcggaaatattagaaaaaaacagcaagtcaaattgtcccataatgaaaagtaaccgcataaggagtgtatcgaaaagtagtcgcaaacattcaaaatggtagatttcagagcatagttcatctttttaaaagcttttttaacgcaaatcttcatcatgtcaccaaatattgaagtaactataaaaatattgaataatgtgcagtcttattataaatacaacaaggtttataaagcatagaaaaaaaaacttgcacaaaattacatttttgaagtgtcttctgaagatttgatgatttgtattgaacaaaatgtatattaaacaaaataggatgaaatgcttattctgtcggaaaatatgtttacttcacacagcatgtaaaacggatatcgaaaaaataaataattgctctaagaaagctcaattattggaaaaaggtcggttttggatagtcacttttgtataatcaacttttgaagctctgtcatatacagcggtaattatatag

SEQ ID NO: 198 - DNA, 30858 bp, Aedes aegypti
ccccctccctccccctattgcgttacgtaatatgtgaacgacccctagaatgattataaaaatgaaagttttttttatctcttttgggtccacccttgactgatggtccatgacttcaaccctgctcttccgcccttcagaatcgatttgttttgggtttctcggctttcatcgacaaaaaataaaacgatccggccgcactgcgccaaattcgacaaacattgtgcgcacccaaagtgtcaaacgagtgcaaatccgcgaaaataacgtgaattttggtagaaaactatgccaaaaccgtgtaaaaagtgttgcaaaacctagaagttgtgccgatgcggtgtaatcaagtggaattcctcatgaaaaagtgaaattcgcgtcgggaagcgcatttttcacctgcgccatcggtggtgctttcagccgggagtgctagcgctactgctcggcggtttcatcgacttttggtgggggggaacggttgttcgtcgattgtttttatccggctgttcgttggcaaaggtcaagaacacgaagcgccgggttgtttactaaacagttcgtcgcttcgatagatcgaaagtagtttcggtagcgttatttttgttgcgagtgttttttttttgttcttagttattagtgattgtatgtgttaaattgcgatcatgtcgacggtggtgctacagttcgtgagtgggctgaaaagccgcaacaaggatgcacagaataaggcggcccaggaactgtcgctgtacgtcaagacggaactgcgcgagattccgcaggatgatctgctggcgttcttcgaggacttcaaccagtacattttcgagatgttgtccagtgccgatatcaacgacaaaaagggaggcgtgctggccatcagtaagtactcgacactcgacagtgatcaattttagtttttcttcttggcattaacgccctcactgggacagagcctgcttctcagtttagtgtttttatgagtacttccacagatattaactgagagctttaccaaagttgccattttcgcattcgtatagtttgttttccaaaatttacatcaaatgacgtaaaattctctctattacagattgcttgataagtggcgatgtggtcaacacgacaactcagatttcccgttactcgaacaatctccggaatcttcttccgtcgagtgacatttcggtgatggagctggcagcgaaggtgctcgtcaagttggccctcctgcccggttccaaaggcgccgagtcgttcgagttcgacatcaaacgtgccttcgaatggctcatggaggaacgaaccgagggcaaacgccatgcagccgttttggtgctgcgtgaactggccgtggccatgccgacgtttttctaccaacaggtcggaagctttttcgagcacatattcgtcgccatcaaggatcccaaaccgatgattcgggagggcgctggccaagccttgcgggctgtactgattgtcacttcgcagagagagggaaccaagcagaataataatcctcaatggtatgttacctttaatctcagacctttaatacttaattataatacacatacacgaaatgaagaattatatacatatacatctttttcgttatttctaggtacaaccactgttacgacaatgcaatggaatgcttcagggagcttccttcccgcgagaaaggtttcaaccgagatgatcgcatccacggagcaataattgtgttcaatgaaatcttacgatgttcaaatgcagcctgggagaaaaagtacatgcaattagaaagtttgaacgtcgatcgcaggtctcgtcacacggatgaaggtcacagcattttcccccggattcgtgtcccgttcatggacaagctaggaggaggacatagctctggagcgtctcgtaccagtgagggaagtgatgtcaaattcttccgacagaatagctccattcaggagtctgcaatctgccgagcgttgacgaacgacaactacgaattgatttgtcagaaagtgcttgagcaacgcaattcaaagtcaccctacgtgattcagtcgctgctgaccattctacctcgattggccgccttcaatcgcagagactttgtcaataaccatttgaaaactgtcgtcaactatcttatcctaacgattaagagcaaagaaaaggaacggaatctggcgttcgtcacgcttggctatatcgccgtggcagtcgagaaggatattgcccccttcaggaccaggatcatcgaggtgatcacggcagctctgcctccgaaagaaaccccaagcaagaagaaagtctgcgtcgatccgtcggtgttcatgtgcatcaccctgttgggtcatgcgttaaaaagtgcaattacaaccgatgtcaagagcttgatcctgccaatgctttcgactggactgagcacagggctaacggtgtgcttacacgagttgagcgagaatgtgccgcagttgaggcaggaaattaccagcggactgttgaagattttgtcctgcgtgctgatgaataaaccattgccgcagtttatacccgggcggcctcaaggtaggtttatttttttctaaatttaaaggtagggagttgttgatcgttatcgtcattaattcaaatttccattagttgcacaatcactgcagaaactctgtatgaatcttcactcgtacaagttatctgtctcatttggcgctgaaaacttaataggtgttggttactccagatatgtgcttttgaaaattagaagtttggcttcgattcatcttcccctcaaaagactgaaacgtcgaggaatgttaggtagataaaatacaatattcactgacacttacgataagatcattccacgatttccggtacgaatgccgaaaacataaactgtaacctttctgagataagatcgagagaggttatgttcgcaaaggtgaaatgggagttgtccgtcgcagaagcactttgcacccggaatcctacatacgaggaggtgcaggagcggaaggacaagctcacagaacttgctggcaacttcgacgcactttactgcccataactgcaaaacagtcacattcgacatttttgataaatcggagttaatataccatgaagagtcatcaaatgttaagagccagttcgcgagagccgcaaccccttcttgtattgatgttctccgatcaggctgaaattttcagtgattgttctactatataaaagatgatgttttgcaaaattagatttttatattagggggaagtgggacaaaattacccccaatgatttcatgtcactaaacatgcaaaatcacaaaaactgatataaatatagtaaaagtacgcggattatgttgaaatttggcatgaatactctacgttatatgaactttgagattggcatggtatatggattttgaaagtactccaaatcgagaaaaatgagtttttcataaaaaatttagtgattttcaaatcgatttttttcttaccaaccgaactaggtcaaaaaactgaatatgacgttttgtagggtaactcatgggctttcatttgaggtgtaatccagatatgccgtttcaaaaattttcgaataaaaattttttttcgggtagtgtttgaacttgagccattttgcgagtaccgcaaccgccttgtctagagaggttgtattgatgttctccgatcgagctgaaatttacaggagttgttttcctatataaaagaatatatcccgcaaaatttcagatttttatattagggagaggtggtacaaaataaccactaataatataatatataaaaacatacaaaatcaattaaagtaatagcaatagtaaaaataaacgaatttgcatgaaatttggcatgtttaattaacgttatatgaacttcaaaatgaacatggtatttggattagaaatgtgtttcaaattaataaaaaaaatctcttatttttttatttaaaaaaaaatagttatttttttcaaatcgacttatatttttgtcaatcgaactagttcaaacaactaaatataaagttttgtagggaaactcaggagctttcattcgctgtgtaccgtagtgaatcaaaatttggacggaaccaatatccggacactctgataatatttaccaataaaatgctaaattgacaacatttatacaactatattgaatgaaaaaatagctgtttttgtagttattacgacgtattggcctttcggaggtctgttcaacaaactgatcaatgtccccgatgagatcagctcaaaggtataaattaattggttagagataatcgtatagcatatttttattacttacatttggtctcttactaggcaaacaaattcaaatttttaaatttaatatagggtaattcaggtcactatctgtaactattcagttttaataagcatatagtaataatatcgagagggattcgcgataagggcctatctgacaaatcaataacaatgggaaaattaccaatgaaattttcatgtgtaatttttaatcccaattggagaaaatatactccagcttcaactatttcactttaatacacatacggcccagatagccgtagcggtaaacgcgcagctattcagcaagaccatgctgagggtcgtgggttcgaatcccaccggtcgaggatcttttcgggttggaaattttctcgacttcccagggcatagggtatcttcgtacctgccacacgatatacacatgcaaaaatggtcattggcatagtaagctctcagttaataactgtggaagtgctcataagaacactaagctgagaagcaggctctgtccaagtgaggtcgtaacgccagaaagaagaagaagaagaagaagaacacatttcataaacctagtttcaaaatcctcatcaataccacacacatctccttcaattttcctagctatttcgtaataaaaaaaaatattataaggttttgccttaaacgcactcaagaatgccagtatcgcccaatgttatgagcctgtaatcgatattattttcagtgtcgcctattacttttgcgccgtgttttcattctggtttcaattaagcccgccatgtacgccttgtttattttttgtttgcagtgtcgccgtttactctcgccgtgttttgatttcaatttcaaatgcgcccatcactttgataaacaaaaacacaggcgtaatcaatacagtgtgtggttttgcatgaggtgaagtttcgtcttctacaaatttacgttttttgaatagttaaattatcgaaatgggaaaagttcaagtgcagtgaatagacaatcaagctacaatttcaacgctatagattcttaaattgtgtacattttgtcagtttcgcctaattcgcgaatctttctagttatataaataataattcacttaataaacgattttgcattcacatcgatcaatcaacaatgagaagttttttttttcaattctcattcccccacttgacatttcccccatgcgttcgaggggcgcttagatggaggcaatcgtcgcagcagtagtgattgtaacattataatacacaaagatatagtttaaaagtttagtgacaccatattgaaaaaatatgctgtaaatatggtttaaaaaagtaaaaagaggctgtccggaattggagcccaatgtttttgaatctggacattgtattggaattgtatgtttcgatgccgtaagtacacaattttcaaatataactgaaataatactttgaacatcatcaaaacatgagtaatgtgtaataagaacaatactgtgcgtcgttcattgaaccaatcagcgatgattgcaatttaaaccaccaacatgtctgtccaaacaactaaatcacaaacattgcttacacaatatgtgttcattactattcaaaaagaaacccatttggcagaactacactttttataagggaaaagtgggtcaaaatgacccccaatatttttgtgtcggaaaacacacaaaatcacaagaactactgtaccgtttaaacggattgtactgaaaaatatgtttttttttgtaaaaaacacacaattttccgtggaaatatgcaatttttaacaatcttcgtctctcttttactctttcgagaaatttgcaaacatcaaggctagtaaaagtcaaaattccattcaagatataaacagtacagtgtctcatagcagccaaatgtgcagtcagtctaaactaagctaaactcaattatttacaaatttatctctagcaaacataccatcatacacacataaatgtgaccctcctaatcaaacctatcaaacattatccaaatttaaaaaaaatgcggtagttgatacccatccaaacagcgtgagaagaaacaacgcttactactgaaccgccgaagctgctaacgaaaacattggtgcaatgacttattgttatccacatcatcacttttgcaagaaagtgacatttttttcagatacggcagcggcaacacggtatgatataatcagtattacaactaccgacaagaggcctccatacgctgctcataccggccggattttgatttaccacggtacaccgcgaatgaaagcccttgagttgtcctacaaaacttcaaccttgttcggttgaccaaaaataagtcgatttgaaaaaaaactaacttaacaaaataacaggtttttcacgatttgaaacatttttttatccaaaatgatcattcatatgacgtaaagtaaacatgccaaatttcatacaaattagtgcatttttactatcgctattcttcttcttctttctggcgttacgtctcaactgggacaaaacctgcttctcagcttagtgttcttatgagcacttccacagttattaactgagagctttctatgccgattgaccatttttgcatatgtatatcgtgtggcaggtacgaagatactctatgccctgggatgtcgagagaatttccaaaccgaaaagatcctcgaccggtgggattcgaacccacgaccctcagcatggtcatgctgaatagctgcgcgtttaccgctacggctatctgggcccctactatcgcttttatagcagtttaattaattttgtatttttttatatattaaatcattagtggttattttgtaccacttctccctaatataaaaatctgaaattttgcgaaatatattcttttatataggaaaacaactcctgtaaatttcagctcgatcggagaacatcaatacaacctctctagacaaggcggttgcggtactcgcaaaatggctcaagtccaaacactaccccgaaaaaaaattttttttcgaaaatttttgaaacggcatatctggattacacctcaaatgaaagcccatgagttaccctacaaaacgtcatatttagttttttgacctagttcggttggttttttcttaccattcgatttgaaaatcactaaattttttatgaaaaactcatttttctcgatttgaagtactttcaaaatctatataccatgccaatctcaaagttcatataacgtagagtattcatgccaaatttcaacaaaatccgtgcacttttactatagttatatcagtttttttctgattttgcatgtttagtgacatgaaatcattgggggtcattttgtcccacttccccctaatataaaaatctaatattttgcaaaacatcatcttttatatagaagaacaatccctgataatttcagcctgatcggagaacatcaattcaacttcccttggaaagggggttgcgtttctcgcgaactggctcttaaatactttcgatcaacttactgaaatctgtgagattgttctagaaaattcgaaaaaaatactaagttgttttgtcacattggtaattataatcgcataacagtcacattgagattataactgagcctcgtaatgtagcagctatgaaatttctatcagaattattttctgacaattcacctagtatgcgatatgagttgtacaaaatatcagcctcaaagaagcatttttgagttcctggtaatttttagaaattttattgcaatttcagggaaaactttacgttttacggttcaacgaaaagctacctcagctgtcacagtatttcatagtgttttctctttcaagcatactatgattgaattgtatgcttcaacgatagaatgatttcgaagcctacgcactgtgttttttttttctcgtttgcatgcgctttttgaatagcgcccaaaccgttgattttagcgatatggtttgttcggagaagtttcgtggtatattaaagcgcaacttttgacgaaaaaagttttgtgatcaatccacctagcagtgagatagaaaaactattttttcaaaaaatttagatagacatatggtgtcttcggcaaagttgtagaattggcaatttgaaacaactttgtcgaagacacaatttttctatcttcttctatactttttgagatatatgccgttgtatgtgaatgacccctaaaaatcccctgtcctttggttcagaaaggggtatgggcgcgttctgccaactcggtcgaggcagatttcttgtgtgaacaagttacaacatggacgttctaaagtgcctgaatgaagtgttgtgcttgtggggagcacttgaagatgagatggatggtcattacttcgcgttcgtgctttactcctgcttatcttaaaagttatatacaataaccgactctaagtttaactatcgaaattaacaattgcaaatacaataatcgttctgagttcactaacatgtcgtcgcgttaattttatcataatgatcttttatctacatccgtcgaaccattctgaatggccgttgtgataatatcaccaagaacttctcacatgcattaaagctgaattgtcctacattgaaacattgaggttttcgctcttttggattcattttttgttgttcgtcctcagtattgttgagatgtcctgaatgcctcacatggcgtacagtgatcattgccatggagtttctcgtaagctgtatggggatcgttatcatgggaatccaaagagcgaattttctatgatttaattgtaggccaatacagcaataaagcatgtaacaatcactaacttttcttctctctttatccttgttttcatatctaacccgccattacaacgaggaaaaatccattggagaggaaagacatggcagcgtattggccgagaaaagttaagtatcatgtttttgtaaatattcttattactgattgcaaggtgaatcagattaactaaattttaaactaataacaaacttgttccacagagctatttacaaaacaccgcccaaaatccctcctttcccatatcttttctccttacccattaggcaaaacacttcactacccctatatatatgactgattcatgttcttttgaccttgcatcattcatacgtgtattggaagtcaagagtagaagcaaaacttaaagaaccttctggtcaaagatgttgcgttgcctacttcccaaactccaaaaccccccggtgtattatggacggtgtgagttttcaaacttatgctggagacttggcccctgacccccttgtacatcaataaaataaaataaaataaaattgtatgtgaatgacccctaaaaatcatattttttatcataacttttttccaagatttttaccattttttgtgttttctacaaagttgtttgtcatacaaaaacccgtgtttttgctgaacatttcattaccctatcttttgaagtaacaaagttattcatgaattactcttttttcaaggggtagtttaggcatctttaactggttttcattttcgattataactttttacttaaatttttaacatttttcatgtcttctacaaaattgttaaacatcttaaaacgcgtgtttttgctgaacattgcacctctctatctcttaaagtaaaagaattatcagtcgaattcgttttaataaggcttatttgtttgatagtaaaaacccatgcaaagacgcttatagacaaaagtttttatcaactgccaaaaggggagatatggtactttcatcatttgtaagaattgtctgcgccattttgcgccgaagccagttatagaggcctaaactaccccttgaaaaaagagtaattcatgaataactttgttgatgaaatgttcaacaaaaacacgggtttttctatgacaaacaactttgtagaaaacacaaaaaatgttaaaaatcttggaaaaagttatgataaaaaatatgatttttaagggtcattctcatacaacggcatatatctcaaaaagtataagagatagaaaaattgtgtcttcgacaaagttgtttcaaattgccaattctacaactttgccgaagacaccatatgtctatctgaatgttttgaaaaaatagtttttctatctcactgctaggtggattgatcacaaaacttttttcgtcaaaagttgcgccttaatataccacgaaacttctccgaaaaaactatatcgctaaaatcaacggttagggcgctattcaaaaagcgcatgaaaacgagaaattaaaacacagtgctacggtagaactttgacagctgcggtagaactctgcggctaccgcaaaccggaaagttttctcaacaaccgtaatagttttctcccatactgccataaaatgcacacttggtattccatttattcaatgcctacttttgtcgaatgttattgtactctgcaagataaatccacgtcatgcgattatctgaaaatgtcgatatactgtcgtagtgataatgaaaatcaccaaatgtttcagatttagcaaatttgaaacatttgtgtccttgaaggacgaaaaaatccaagcctacttgaattttgaggttgcgtttgaattgcgcgcatattttctgcgcgttaccgccaccgctggatgtggatttaatataagcgccgcaatacacatatgcagttatgggcagtttagacctcgatcgaagagaacaccagcaacttgcaagacgtcgcgtcggagttcaactgtcggctgcagttcgacgatgtgtatttcaaggccaaagaattgtacacggcggtccctgaggataatcagaacggatgtccaactacagtggcggaaccggagaatcgattaatgacctgcgggatgcaatcagagcgctcgtcgaaacgcagcaagctgtgatcatgcatcaaatccaaccctgtacagcacccgctgccggacaggtatcgaatcaggatcaccatctgaacgtgaagctgcctcagctcaacattccagtgtttaaaggagagcgcaagaacaggcactccttcaaggacctgttcgtgagtgccatccacaaaaggacggacctaaaggattcgctgaagatgcagtacttactgtcgtatttggatagcgaagcgaagaagatggtcagtttgtttccaatcagttgagcctggaaaacactcgtgacgcattacaacaagaataagtatacggtgtttgccctggttcgaaaattcatcgacaactgttaacctgcctcaataagctggtgacatcccacgacattatacgtcagctcaaggctctcgacaacgagtttgaatcggggaatccgtggctcatccacttactgctggagaaagttgacagagaaacccgatcattgtgggcgcagaaaattatcgatatcgattggagtttctgcagaagcggtgcggtgcactcgaggcgtgcacagcgttcacaaaatggcccagtggagacatcgtaaaaaaggagtaccattttgattcgagtcccggacagcttcaaattttggacactactttgtatgggacagatttcactcgaaatgtttcaaattttgccggtaaaaagttcccaaacgtcccaaactaaatgttttagggtaatagtcaatagggtgatagtcaaaactgaaaaggcaatagatggctctttttcaatggtagtaaaaacgaaatcctgaagcaaagaaagcaccacggaatatgaactaaacacaaaaagtaatgtattcactttacacttgatttctaatcactatttttttgatccagtttcctaattgcaagcaatttacgattttcattatttttcatacgttttgacagttctccgactaccattcttccatgcgcttgtgttgaaagtttgagaaatttgagaatccagcgtagcgcgatcagtgggtgacatacaaacaacagtgtcgtcgctcggcggccggtaagagaaactgaatgttcgataggttgttgtctgtaatttttgctgctggcgccaactgttattttttgagaacaaaataaacagtcattaccctattacgaattcattaaacgcgacatcgtagcagtcagggtggaggttcctaccgctagggggaaagctgatatcgtcatggtctcggcgtatttcccaggcgacgcggaagatgttcctcctccagagattactgcgctaacctccttctgtgaaacaaaaaacattccccttgtcatcggatgtgacgcgaatgcgcatcacactgtatagggaagtacaaatataaatcctcgagaggagcaccttttacagtttctatcctcaaaaaacatttaaatatgtaacacaggtgacaagtctacatatgaaaacgccatacgacaggaagtgctggatctgactttatgtagtcagtccatctcccataaaataacaaactggcatgtttctgatgaaatatctatgtcagaccacaaacacatagtctttgaatgggaacccccttcccattgcaaaattgtttaaagatcctaagaagactgattgggaaacctattcagccactctccgatccgaagactacatcataaatcctaatatcaaaacagtattagagttagagttgactctataaaatcttaattcttctataaattcttaatgcatatcaagaaagctgtccgactaaaactgttaggtcgagcagagatgttccttggtggaacaaccatcttgaaaactgcacggagggagttcaaccgtgccaaacgctctattgattggagcctataccgaaaggctctgacagatcacaacaaggaataaggctagccaagcggaaatcatgggtcctcatgtgtgaaagcattgagaagactcacgtagctgccagacttcataaaactctatcgaaagaccactcagatgttctgggaactctccgaaagactgacggttcgctcactgtggatcccacagaaacactgagtgaaatgctgaggactcacttccctgattcaatccctgaagcgagcgtgaacgctaatggcgacaaacatggcgtctctggtcaacaagagctcctgtcatgggactcagcctttacgcgagcaagggtggaaaaggcagtgagatcctttgagccatttaaatctgctggcatggatggaattgtcccagcgcttatccagaaagaggagcaaacgcttatttctcccatgatagagatttttaaggccagtttagtcttaggacatattccagatgactggcgtcaagttcgagttgtctttatcccgaaggcgggaaaaaaaagacaaaaccaatcccaaagcttacagaccgataagtctgtcgtcagtgatgcttaaaataatggaaaaggtcttaggagagttcataaattcaaaatttatggaagcaatgcctctttccaaataccaattcgcttaccaaagtggaaaatctacgatctcagcactacacttgccagtcaacaagatcgagaaaacttttcatgcaaggaaatcgccatcgtggcatttcttgacattgaaggtacattcaataacgcttcctattcgtctatagtgtcagcaatgcataggagaaaatttgtcccatgcattgttacctggatacatgctatgctagcaaatcgccgaatctcatccgagttgagcggatcgtgcgcaactgtcatggccacaaaggggtgtcctcaactcctctattttcacctttgctatggtctctagtggtggatgatcttcttaatagcttggaaaaaagaggattcgaggttgttggttatgctgatgatgttgtcatcattgtacgcggcaaatttgaaagcgttgtccttgcaagaatgcaatcagctctcgattacacgctctcctggtgtctgaaaaagaatctggggataaatccttcaaaaactacgattgttcctatcacaaagcgcagaaaggtacagctgcaacctcttttccttactcagatacaattggtttgctaaaacgaaatcaaatatcttggcattacgcttgatgctaaactcaattggaacacacatcttcaaaacatggtaaataaaggtctcaattctctgtgggtttgctcgaagacctgtggaaagaagtggggcctaaaacctaatatgatcatgtggatatataaaaccatcgttcggcctagaatagcctacgcttcccttgctgggtggccaaaaacaagcgaggttacggctagagccaaccccttcatttgccctagatgcaatgcttaatctgccccggctagatcaattcataaagctggatgctgagaaaagcgctctgaggccaaaacgatcaataaaccttctgccaggtgatttaaccggtcacctaagcatactaaacgaattttctataaatccaattgtagaaaaatgcagtgactggatggaaatggttgtgaattatgacataccatatacggtattcattccttctcgccaagagtggcaagaaggtggaccgagcattcctccaggctcaatcaaattctacactgatggatcaagaatgaacaatcgttctggatctggagtgcacggaccaagaactaaaatatctgtccctctcggacagtggcctacagtttttcaggctgaagtgtatgctatcattgaatgtgcgcagctcagcgtaaagaggaattacagaaatgccacaatctgtattttctccgacagccaagcagctctacatgctctgaaagcttacactttcaactaaaaattagtgtgggaatgtgttcttgctctaaaaaccctagccatccgcaatagaatcaaactatattggatcccggggcatacgggtctagaggataatgaaattgccgattagctagccaggatccatttcatacatttattggtcctgagccattctttggcatatcaaactgctcactaaatattgaactgaacagctggttgtccagtcaaattatatccaattggaaaacagtttccaatgcgaatcaatccaaaagtttcgtcacaattaattcgaaacaaacacaaaaactcattggtctcaacaaaagggacctcaacacctacaccgtctaataataaccgtctaataactggacactgccccagcagataccatttacaaaagatcggagtcatccaaaatccaaattgccgtttctgtagtgaaacgtgcgaaacctctcaacaccttctctgctcctgcagtgcacatataaaacgaaggtccaaaatatttggcaagccctttttggagccggccgatatttggaccgcatccctcagggaagtggtcggctttatcaggctgatcgtaccagattgggggattcacaatgctgcaacttaggacttctgcccatcaatggcagatggcttaaagttcagtcactgcgcaaagtattccggtggcgttctcgccactgagggtcctgtaaaagcaatagttctaaaaaatggacgcacacccgacagaagaagaaggaagtccttatgccgatctccagatttaaagcaacgtccctacaccttgctatgcacacaggaagtaagacaggcggacaagaagccggaacatggatgaatttggtctgcaagcaatatcggcgtcggtaaacgtcaattcagcgcagacggcagtacaagtcgaagtaagtgatgacaaattgcacaacgttcgaggactagtggacagcggctcgcaggtgtcgcttataacggaagcgtgcttaaagtgtcttgggttgatacgtagcaacactaaactggaggtcactgatgtgaacgcagaggtcgtcggtagaaccgccggcaaggttacgcttgtgttgtatcgcgctacgaggatgcaacaaagctaacaactcaaacctacgttttgggaaagctgacggcaaccctaccttgtcagtgcttcagcgtgtccttcatgtcatacttggaaggattgcagctggccgatccgcagtttaacaagcctggaactatggacatcgttctcggggccgatctcttcctgtggattctactatcagtcaggtgatgcaccgcgttccgtcttcgaaggaatggttgcaggaaggctgccgaaacaaaaaaatatccatacctaccattcgaacatcaatcgctccaagaggttgacatcgatcgtacgctgcgattgttttgagaagatcaggagctacacaatccccagtaactcaccaaggatgaacaaagtgtggttgaagcattcaaccccactctgacacgttcacaggaaggtcgcttcatcgtccgtttgccaatggatgacacgaatctcaaactaagaaactcgttgatcgccgctaccagacggtaaaatgcatggaacgcagattcgacagcgacaacaatttcaagcaacgctacctgtcattcatgcaggaatgctccaaatcgtattatctgccataccacggcgtcattgaagaggacagcatcactactaaacttagagtagtatttgataactcatcagctaccacgactgaagcatcattcaacgaggtaatgctggaagctccgaacatcaacacagatctgttcgacgcactgctacggttcagatcgtatccagtgatctccttggcggacatcgaaaaaaatttctggaaactgagcgaacatctcaagttgttgacgtatcgacacacccgtgcgagctgtcagcaggcggcagagagattggatcgacgttccaaaatttcgctttcgatgacgtagttagtggctggaggactaaaggtgacattgagcgattggtagcgcttacgtacctccagtgtttcctcgtctcggttccacgtagaagaatcatctgacagccacgagggatctgtacaccaaagcggatgatcgacaagctccaacggagaaatctacaggatgcaccgcctgtttgattttccttggaagcaacgtatgatcagtgctttctaggcaaggtgtctaaaatcgatgacgttctgttggctatgtaggtgttccacttgcggggtgcaatacgatggtgaaatccgtccagacatactgatcgatttggaatctttcgagtggtgcggaaagccagtagtgtcagggtgtctactacctggaaaaacctggaaaacctggaattatcagggaattttatttaacctggaaaaacctggaattctcagggaatttcggccataatcagggaaattattttgaatcagtaatacaaggtagaatatgtccttttcgtgacagaaaatcttttcaatcaaagaaattttcggctgcgccgctgtcaagcagctagatgatcagttcttcattttttctggaatacttttatgaacttctcaagggatgctaccagcaatttttcaagagatgtgcaaatgaattccttcacaaattttgtcaagataatcgtagagcactgcaacattattacctccagtaattttcacatagatcaccctggaaaaaaatgacagtaattatcccaggatttcttccaaatgtttttccacggattattcaacgattttttcagttgttacttatatgagatttatcataaatcctaatgaagttcttgtacaaagatgtattcgctagtttcgattacgacgattttttcctttttcatatgtattttataaaaaagtcagccatgattatatttagaaattgctaagaattgcttcgttttattcgatgaaatattttttgaactttttcaagaattccccaaaaaattgacctggaattcctcattaagttccttcagcaatttctcagaatttttccagcatttcatcaaaatatcattgaagaggttcaaacatttgtctaataatttttcaaataatattttcaagctccattcttcaaaacttcaatgaaagttccacatcagttattattacagtcattcttacaggtattcttcaagttatttatacttaaatttctccaggaagcctctccgaatttctccaaaacgtcttgtaggacattattcagagtttctatgtttttttctcaattatattagcgtttatcaagaaaattttgagaagaatttcatcaagactacaggagttttttcagagatcctcgtaagaattcatcaaggcatagttagaactcacaaaaaaatttctttagtaattccacgcgtttttttctcaacatttcctccaaaaattctgaatcaaattcttgacatttccctggagaaatttttggaagaatgactagttatttttttttcagatttctttgggaaataataaaaaataacaggaaatactaattctcgaaaacttattcatacagactcaagtcaaaaaagtatacaaacttactttatcgatcctacgtgttaagcaggcggaattctacacgtaccgctctgtaccaactcaacttttcacttatagaacgtttaatttccgaatttacaaaacgacgaaagcaagattttcaactttcgaaacctaaccactactttcgccgccccgctgtatggagagacaaagtgacttaaccacgaatcaaaacaaaacactacttgagccgattttacactgatagaaaaacgtcgaaagtaacttgatgaaacggcttatcattttttataattattttttttgggaaataatagaaactacgtagtttttgaacgcgacctgattgtatgcaaaatttaagtggcgtacactgcgaaaaaatgttaaaaaggtgatttatttaaaaacagttttagaagaaaggttatgattcttcggaattaattttctcaaaaccgtatgaaagttacttacgacgatttgaaaaagtaatcgagaattgaattttgaattttgaagatgctctaaacggaaatgttggagaaagtcgtaggaaaatccatggaaacattaatggatacattttttgagaacatgagacttcttttggaaattcctccaacagtctttggagggattgctgatggaaactccgaagttgtttctatggttatccccagaaaaactccagattgagttcttgaaggtatccaaagataaattcttggaagaatttcttagaaagttcttgaaaaatcacaaaactaactcttgcagagatcgttcgattaagatgagaagaaatatgcagtaagacaagcattaatacttgtcgtaatgtcaagggactccaaaaaagtcttaaaatcattttcagagaaatgcccgttcaaataaggaaccaaaatatcatgacgtggttcatgtggggtttcttttcgtattcattgttcatgtatggtctctttttggcttatgtctgtgcttatttcatgcgagagttatttaaaattatatttgcaaacgaaaaaaaaaattaagctatgttgaatgaactatccaccaatcccttatttattttggatatttttttacccggaaaaacctggaaatctcagggaatttcatttttgtaaatgagtagacaccctgagtgtgataagatgctgataaaaatactgattatgtgcactgaaatctcataaaattcaacttaattctcttaacccgtataggcctgaaagaaagaaaaattactaaaactttcaccgctcagcgaatacttaacggattcaaattattttttgtcggtatattcgtacacatatcaagtttctaaaagtggtcaacgattctcgggaatgttcctgtggccggagttattgcagtggatcactgggtcaggtcgggtgacaagggttttgtgcttctgagcccctggaggtaggcaaatttcacgtcacagataattttcagaatcggctataatgtggccactatatcaaggaattttaagaaaaacgcatcaacgtaaaccttctgataatcgattaaattgaataagtatgtcaactgcatttgattaatcctacaaatgaccatttccgaaacccagggatgcctaaagatgataaagtgcacaatttgtatcttaacatctgagtcaagcttatgggaacgcattttagtgaactattatgttcgatctatacttttagagatttcaaaaagtttaatacctaaccaatttagagccggttcttcaggacattaagcccgagtggctgcatctagtacactctaaatggtgcaaaactatacatttgtaatgttgaatatcagttcttaatgatttatgcaaaataaaatgaatgccattggaaataaataaggataacttggcatgtcccaaaaaaatcgcctttttctacccgacttgaccccttgacccaccgcaataactccggctacaggattattccagagtttctccgaccatttctagaaattagatatgtgggccagtatactgacaaaaaaatatttcaatccgttaaatattcgctgagtggtggttttagtatttttgctttcactcaggcctatacgggttaaaacattcattagaattgcttttcgtaagaagaggtagtgttatcaaagtgtttattaaagtcaaactaggtagtttgaaaagaaagaatgtggacagaaatatggataatctactgatttattttataggtgtctctgaatcagaccaacaacttcctaccttcttgaaatttagaaataaatttgaactaaccgatttcatttttttgctaggtggaatgaacacgagcctctacgagcaacagatccaagatactcccaccacagtgctggccctccgtacgctgggcaccttcaatttcgagggtcacagcttgttgccgttcgtgcaacgatgtgccgaccatttcctgctcagcgagcagcaggaaattcgcatcgaagccgtacagacttgtacgttgctgctaaagctagctctccaatcggtcgattcggcagacggatcggaaaccctcacccagaccgttggaagcgtgctggagaagattctgatcgttggtatcaccgacgttgatccgaatgtgcgtctgagggtgctgaaatctttggacgacagcttcgattctcagctggcgcaaccatggttcctgagctcgctgttgatcacgatgaatgatgaggtgtttgaaatcagggagctagcgattatcatcattggacgactgtcggccatcaatccggcttacgtgatgccaagcttgaggaaaacgatggtacagatcctaacggagctggaacactccggtatgagtagaaacaaggagcagagcgcgagaatgttggatcatctgattgtcagcacgccgaggttgatatcttcctatatgcgtccgatcttgtcgatcttggttccgaaattgaaagagcctgaatcgaatccgggagtggttttgaatgtgttaagagcgattggtgatcttgctgaagtcaatggcggccataacgttttggagaaatggtccgatgagctgctggctacgttgctagagatgctaagcgatgccggatcaacggaaaagcgcggcgtagcattatggactcttggccagttggtcagtgccacggggcaagcagttaaaccgtaccacaaatatcccaatctgatcgatatattgatcaactttttgaaaacagaacagcaaccgtacgtaaggcgggaaacgatccgtgtcctcgggttgctcggtgccttggatccgtacaagcacaagatgaatcgtggcctgattgacagccagaccaacaatatcctcatttcgatttccgacagcaagactgaggaatataccgatttgtctacgtcggaaatgttgatcaatatgaacaatcagctggaggagtactacccggcggtggccatttcaacgctgatgaagatccttcgtgatcctacgttatcctcgcatcacaccagcgttgtccaggcgatcacctttatcttcaaaagtttgggtatcaaatgcgttccgtacttgtcccaggtcttacctagtctgctcggcaatattcgcaatgccgaaatgaacttgaaggagttcttgttccagcagctatcgatcctgatcgagatagtcaaacagcacatcatcagcttcatggaggaaatattccagctgatcaaaacgttctggaacagtatctatcctttgcagccgaccctcatcattttggtggaaaagatcgccatcgctttgggatgtgagttcaagatctatcttcctcagttgatgccgcagatcttgcgagttctccttcacgatgcgtccacccatcgaatagtcaccgtcaagctcctcaacgctctgcagaagttcgggaacaatctggacgactatcttcacttgatcattccagccattgttaagctgttcgaaccgatcgaagttccttaccaggtgtcccttgcagccctagaaaccatcaactaccttgcagagatccttgatttcaccgatttctcctcgcgcatcatccatcccttggtacgcgtcctggacaaccacccgggtcagctccaaacggccgcgctgcaaaccctctgctcgatcatgatccaactgggcaagaaatacctcgtttttgtcccgctagtcaaccgggtcatgatcaggcacaaaatatcttacacagagtacaacaaactcctctccaagctgcaaagtcagagtaccctcgccctggacgatgaattccgactgcgccaagctcggttcaagaatcgcgaaatgtccctcgctggggacacgaccatccgcaagttgaacgtgtccaccgcggatcttcagctggcgttcaaagctaatcgcagggtgtcccgtgacgattggctcgagtggctccgtcggctcagcattggtcttctgaaggagtccaaaagcccagcgctgcgatcctgccgaaccctggcccagaactatccccaactgttgaaggatttgttcaacgcagccttcgtcagctgctggaccgatttaccggacagtctcaaagaggagctatcgtccagcttgaggcaggctctgatggtgccggaccttccggaaattacccaaaccattctcaacctggccgagtttatggaacactgcgagaatgatgcgctgaggatcgatccgaagatcttgggcgagagagccatggagtgccgagcctatgccaaggctttgcactacaaggaggaagagttcctgaacatgaaggacaaggatcagagcgtgttcgagtcgttgattttgatcaacaataagctgcaacagaaggaagcggctgaggggctgctggagtacgccatggaacacaggagcgcttctgaggaaatgaaagtccaagtgaggtggtacgagaaattgcacagctgggagaaggcgttgaacttgtatcaggacaaattggagagcaatccgggtgatttggattcgcgacttggccagtggaggtgtttggaagcgctaggggagtggtcaacgttgaatacgctgaccaaggagacgtgggaatcactgggaaccgaaggacagagtaaggccggtagacttgctgccgctgcagcctggggtttgaaggattgggagggaatgcaggagtttgtcaagttcatcccagaggacacgcaggacgggtcgttctatcgtgccgtactggctgtgcatcacggtgagtatgaacttgcccaaaccctaattgacgatacgagagacttgttggatacggaattgaccgcgatggccggcgaatcgtacgaacgcgcctatggagcaatggtttgcgttcaaatgctgtcggaattggaagaagtcattcagtacaagctgattcccgagcggcaggaaactatcaaggcaatgtggtgggatcgcttgctcggtggccaacgtttggtggaagattggcaacgaattttgcaggttcatactttggttgtccatcccgcaaatgacgtcaaaacgtggctgaagtttgcctcactttgtcgcaagagtgattcattgaaactttccgagaagaccctcgtcatgctgcttcgctacaatccctcggagtacccggatcatccgttggaattcatgcaaccagacatcagctttgcctacgcgaaacatctgtgggcagctggcgaacaagaaaaggcttacaatcaacttaatcgactagtcgccgatatgggcatcgagggtaacttcgacgtcgaggaaaaggacgaaaaccgccgtctgttggcgcgttgctacatgaagctcggacaatggcagaaccaactacaaggactcaacgagcaatccatcaagggcatcctggcatgctacgaaaaagctaccaaacacgactccaattggtacaaggcatggcatctctgggcctacatgaactttgaagttgtccagaatcagaaacaacaggaagacctcatcaagaaccctggcggagacaaagagaagtgtatgattcggcagtatgccgttccagcggttgaaggcttcttccgctcgatcaatctgtcacacggaaactccctccaagacacactccgtctcctaaccctctggttcgactacggacagtatcccaaggtgtacgaagccctggtcgaaggaatgcgcgtcattgaaatcaacacatggcttcaggtcatccctcagttgatcgcccgcatcgatactccgcgcaacctagttggccaactaatccaccagctgttgaacgacatcggaaagtgtcatccgcaggctcttgtctatccgctgaccgttgcttccaattcggcatccagcgcgcgacgacaggccgctcacaagatcctgggctccatgggtgaacattcgtctaacttggtcaaccaagcgatcatgtgcagcgaggaactgatccgcgtggccattctgtggcacgaacagtggcacgagggcttggaggaggcgtcgcggctttatttcggcgaccggaacatcaaaggaatgttcgaaacgttggaaccgctgcaccaaatgcttcaaaggggacctcaaaccttgaaggagacctcgttcaatcaggcgtacggtagggatctgaacgaggcgcaggagtggtgcaaacattataaggtaaattaaaaaatgttgtaaactactgtaactaaatcgttatttctttcgcagaactcgggcaacattcgtgacttgaatcaagcgtgggatttgtactatcacgtattccgccgaatttcccggcagttgccgcagcttacctccctagaactacaatacgtcagtcctaagcttcttgcctgtcgtgatctagagctagccgtcccaggaagctacgcccccggtcaggagctgatccgaatcgccagcattcaatcgaacctccaggtgatcacttcgaagcaaagaccgcgaaaactttgcatccgtggctccaacggcaaggagtacatgttcctgctgaagggccacgaagatttgcgccaggacgaacgcgtgatgcagctgtttgggctggtgaacaccctgctgctaaacgatccggacacgttccgtcggaatctgaccattcaacggtatgcggtcattccgttgagcaccaattccggcttgatcggttgggtgccccactgcgatacgctgcacacgctgattcgagattaccgcgagaagaaaaagaccatgctgaacatcgagcatcggattatgttgcgaatggcaacggattacgaccatctgacgttgatgcaaaaggtcgaagtctttgagtatgcgttggagctcaccaaaggagacgacctggccaagctgctctggctgaagagcccctcgtcggaggtttggttcgatagaagaacgaattatacgcgatcccttgcggtcatgtcgatggttggctacattctgggactgggcgatcgacatccgtcgaacttgatgctggatcgattgagcggcaaaattctgcacatcgactttggcgattgcttcgaggtgagtattcaatcagagtcattacatgcagtaatagggtggccctagtgatcaaactgcaacaaaaaaggaaaaacatttcaaaagggtacaacgacattggtgaacattggctttgcaagacgctattgaacccaattcaactcgatctgggttttgcatctagggataaaaatgatcaaatttggagggagtaacttacgatctttacacagggtgtctactacctggaaaaacctggaaaacctggaattctcagggaatttgaattacaatcagggaaaatattttggggtagtaattcatggtagaatatgttcactacaaagattttttgcgtcaaaatccagagattatcattacttcaatcaaaaaaaaaaaaaaaaaaatcggctgtgccgctatcataacgttacttaagctattcagtgaggatctcttcaggtatggaacttaatcgtcttactaaacatcaaatatcttcaggtatatttgatcagtataggattgacgtatgtagggctggggggcaggtttctttttagagacttggtctctatttttattcaaatctctaataagtctctatttataatgaaaggtctctattttaaccaatatggtctttaaagcattttttccctatcttgcttgtggtgaattctgatgcaaaattcattaaggcctcgagaaactttcagagcctgttacgagactattcaactaattctatcagaaattcttcacatatttctagagaaaatgttccaagaattttcattgtgttttctccagaatattcatctggaatattttcagggactaatacaggattctctccaggaattcttcaaaagattcctctaccaattctaccaccaatttgtcaaaggatgcttaaagggatgtcgccagtattggttcaggacatccttgagcacttcaataatactacctccagtcatttccttaggggttactttttttttccaaagactattctaggacttcctcgagatatttttcactaattcttcaactgaattttccagctgtaactctatcagatcttttaaagattcccacagaatatcttccaagaagcccgcagaggttaattcataagctttcaggcatttttttaaagaatttctacgccattatgtccacattcacttcaaataattgctacataaattcctcgagtaattaatcagaaaatctattaggaacatttcatattcgacctgtgtttcgtggttcagtttctctattatttatttttggaatttcctctgtatttcatccaaagattacagtttttcccaacattcctcaatgaatctaataaaaaaataccatagaattctcaaaagttcgtctaagattccacattagttactactacagctgtttttccaagaaatcctccgatcattcctacacaatttcgtagcgatttcgtttttcaaggagttgcttcacagagattcaatattgatctgtttctttttgtttcattaattttagcaataactcttaagtttgtcaagtgtttttctaaaaatccttatttatcaaaaattactaaacaacttacacaagtttttttagaggttactcttgctggaaatttttcacgaaaaactcttggaagaatgcttgaaaaaatctgggaaaacttcattgagaaatctctaaaatttactggaggagttactgttagtggaatttcctttatcgctatgattctatatatgtagtgcacaacccaataaattttcagcttcatcggttcactaaaactcgagatttgcttccacaaagttttgatgataattgttagagtgagacgaaagatggggaaaataacacggtctccctgctgaaggacaattatgtaggaaatcctgagaaatccctggaggtatttcaggttgaatattgcaacatgtttaaaacgggagcctttggacgatgttctaggaaaccaatgggaaaatcaccaaaagaaaccttgaggactagagatgttcttgaaaaatatctgaaattgtatatgttattctgtgattatttttggaaaatatcaggttttttttaagatatccaaaataaaattcttggagaaattctttgggaaaattcttgaagtggttttatgggaaataatcactaaatgaaatccgtgagaaaaattcaaatctctcaaattaaaatatctatccttttattcaatttgaagaaatcttcagagttatatctggatctttggacaaatacctgagattatttctaatgaaattccttgagaaaatcattgcaagtgcagtaatacaaacactattatttgtcgtaatgtctcgaggaagttcaaacagaaaaaatattcttagagaaatgtcagggctgattccataaagaatcaaacttttttctcctggttcctgttaggtctcgatttggtttttgattactgtttgctctcttttttcaagcaagaggtttctgaattttccatgcttcatgaacaatttctaaaattattggaaaatgttcaatttcggaaaaaccgattccggataagtaatctggaatctggaagttgtttaaactttgaatcatttttttacaatcatgattcatgcagaactcttgaaagttttcgaatgaaatgcaaacaattgaccaacattgtaaatgttatacagatcgggttcgattgaacgggaactttattatccgtgttttaaacacgatgatggaaaaacttttacaaacaaaacaccatcattattgaatacaattcatatgaacattcgaattaagcttcaatatgtttagcacattgctttaaaatgactaaaagagtgaatacactttaaaacactttttaaaattgtctaaattgtgtaaatttagtttgttttggtcatatacaattaaagtatttcttgaacttggaactaatttataaaacccggaaaaaacctggaaatatcagggaatttcaattcggtaaacgagtagacaccctgttacagcttggtttatatcatttaaaaatagtttaccttaagaaaaataacaatctttctctttccaggttgcgatgacccgcgagaagttcccggagaagatccccttccgtttgacgcgaatgctgatcaacgccatggaagttaccggcatcgagggaacctaccgccggacgtgtgaaagcgtcatgcacgtgctccgtcgcaacaaggacagtctaatggccgtgctggaagctttcgtatacgatccattgctcaactggcgcctgctggatgtggacaagaatcgcaggtccaagaatgccaccgacgtggacagcacaacggaaagcatggaagaaacgttggatcttctgatcaacgccagaaacctgcggatgaacgaagccaacggaggcggagacgtggtggatcagggcagcaattgcatcgccaatccagccgaggctaccaacaacaaagcccgggccatcgtggatcgtgtgaagcagaaactgaccggaaaggacttcaacacggtcgaaccggtgcaacggcagatcgatctgttgatacggcaggcgacgaacaatgaaaacctctgccagtgctacatcgggtggtgtcctttctggtagacaccggaaatcgctaagtttgcaattatacatattatattatcttctaaatacttgtgctgctttcggcacccattatgatatctgtcgatgtgggaaaattacgactattaagatttgagttgtgcgaaatcaacaagcaaaacacctatattatattagaacctaagcaagggaaagttaaatgtttaaatcagcattactgcagaagtttaccataccttattttgtatttagcttgtagaatacgacaacaaagcaaatatacggctcagcttatgcaggaccgaaggttgttaagttctggaaagaaatcctgaactacatggattcatactgtgtgctgtggttttcccgagaaactgactacactgttcaaggcaacgatgaatgtcgttgggggtaacattggtagcttcatatcacttcattaacgttcaacgttccgtcatcgtaatcatcgtcatcatcaaaatttcaaaaacagtttttccaggggagtgaaatgagccaataattagctacccaacattaatttaacatggcgtaaagtgtctttgttagtcctcagagtttttctgtccaactcttaaaattcttcgataaaaatgtgttcactgtttttcggttggtttggttggtcgccacgagagagtgaatgttcgtttatagggctctccgattgcgaactgttacactccctgaatatggttcgatgggcttattcggatcaaaatccaaacactgaccgcctcccaagaatatggccgttcgtagcacctatttccagcacatctctcatcggtacacctggagatcaccacagcagacggaatcacaaatcgatcacgttctgatcagaacctatcgtggggctaacatgacc

SEQ ID NO: 199 - DNA, 3839 bp, Aedes aegypti
tagcaatggaaaaatacatttcagtcatattggtgcttacgtcgactatgcgaacatggacatagaaagttatgttgtctgtgatttggagatccatatgaccccaagtcacagacaacataacattttatgaacagagagaagatgaaaactttaaacaacaaaccatatttttttatgcttctttgaattggcggacgcttcgaaagcttaattaaacgaaattacgacctttttattctgtcggtattcataaataaaacgacatctacgtgcagcgcttataaaaattgacgaaacagtaaattttggatacatcaatgtcgttgtctggaatttgaagcgacttcgaatcaacacagtactacggaaatacgttctcacattatgcaaaatgctaccacgtggaccgtgtgatcgaaacaatccaaccgacgatccctgaatgggaacgcatgcgcagtcatgcaatcctactccccttcattcctgattccattcggacctcgattccgtcccgttaccatgggaaactggtagtggccaaacaaacccacaaacacaaattttcaccttccggaccgtgtttcggatagaaccatgaactccctaatcgaggacgatatatacggcggattttccggcgttaccaataaactgttcaactacgacatcaaggaggacaaagcgtttcaaaatgccgtgaaaacctccagctacggcaagaaaacttcgacaccgaagttcttctgggtaagttggcgtcagaagaaagagatgtcgttttgaaatagttttgtggttttctttccagaatggggacaaactgggttcggcggacgcttcggccacaatggcacgtccttcaacggccattcgtgcagtgggatactcttcgcagagtagcaaactttttgatccactgaatcaggctgcgaagaagatcgtcgtgatggagagcaagaaagaggaaactcctgaacagcgctataaaaacatggaaaccaagatctacgcactgctggaagaatcgatcattgccagtactggccccaaaccagacatgttggccgggctagcgaaagcgaaggaagcctcggcaatggatcgaacattgttgcgtatgcgagatcaagatggtggaacgtatactcacaattttgacctgacgttcttcgtcctgttcaacctggccaacgtgtacgccaagaacgagatgtacatcgaagccttgaacacatacacgttgatgaccaagaataaaatgtttcccaatgtgaaccgtttgaagatcaacatggggaacatctactttcatctgggtctttacacaaaagcgatcaagatgtatcggatggcgttggaccaggttcccagcaatcagaaagagctccggctgaagatcacccataacattggcatactgttcattaagatgggccagtactcggatgctgcgactagttttgagtttatcatgtcggagaagggcgatctgaagaccggactgcacttgattttgtgttactacgcgctcggggacgtagagaagatcaagcacgccttccagttattgctggacattcagatcgattacttggaagatgataagatttttcaaacgaatgtgagtattgttaactaatgtgtttactgtgactaaaatggatcatttatttttccagtccaatccatcgtacgagtacatcaacgaaatgatcaagtccgatgagctgcacgtctacgaacagaagatacgacacctggcggagaagaacatactgatttcggccaatctgatttcgactataatcgacgattacttcaacgatggctacagttggtgcgtggaaactatcaaaaactcctacttttcctctctggctgtagatttggagctgaagaaggccgtcatctacctgaaacaggacgatattcagcaggcgatcgaaacgttgaagtacttcgaaaagaaagaatccaatattgccatcaatgctgcgatcaatctcagcttcattcacattctggtataatattcttaattttgaacaatgatgataataattaattacttcccacaatttcagaaaaaggacatcgccacggccgaaacctacgctgaaacagccaaaaaaatcgacagctactgcccggctgcattcatcaacagcggagtctgtaacttgctcaaaaacgatctggaaacggcaaagcttatgtttttcaacgccctggacattgactcgacttcgttcgaggcactgtacaacattggattgatcttcaaaaagcttggtgatcataacaactcgctgctctacttccgcaagatcatatccaacctgggtcacgagcaacatccggaggttctctaccaaatcgcgagcctgtacgatctgctgggtgacgttggaacggccttagaataccacttgcagctgttgagcctggttcaacaggacaacaagatcatccagaagattggcgaactctacgagacggatggcgaaagacagcaagcctatcactatcaccacgaatcctatcgcattttccccatcgagtccagcgtgatcaactggttgtgttcgcactacatcgagcttcaggtggtcgagaaagcaatcgggttctacgagaaggccgtccttaagaacccacaggatccctattatctcctacggatcgcaggctgctaccgccgtatcggcaatcagcaaaagtcactgaacctattcaagatgatccacgaaatttacccggaaaacgtggactgcttgcgggcgttgatccatctgacccagacccagggcaacaacgaactgtgcgagcggtacatgagtgaactgcagaagttggagaaacagaaagaagttcgccaacggatcaacaccagtagaccgccaaccacggcgagcagttcgcgaatctccagcggtgagcacagtgctcgatcgggtgcgggtggcggaggatcggacagctatcaaccgccgggtactgcatcaggggggaacaagagttccgacgtatcaccaggtgagacggttttctcagatattcttgtaggatgccaaaataactgattcgttttagattacaacgcaagtgcgtacggctatgcggatcctttgggacctccccaagaaagaccacgcaccggagtccgcaaaaatcttacgctggacgatgattccgatgaggatataaatccgtacgatttgttgccggtttaagtgtttaagtactgtgagagccttcgatcatttttaaaatagtggttttcttcacaatgatttaccgagaatatacgatcaatacgatttgtctttttgtctaaaacatcacctttttagagttgaaaattttgtcactatcaagaagcttgtaaaacatctccaactttgaatgctttcaaatcatgagttatatcttaatcaattgggttctattctatgagacgcgtgaaaatctctttaaatcggatacttctcaaattttcagggattaaataacaaggtgaatacttgtacatttctcttaacactgctcatgagatcttgggcgaggctttgcccatctttcttacacaatttctcccagtttttcttcaaagattcatccgtttttaatgtttttctgcttttcatcaacttcttctccattatcgcccataacttttcgatcggacgaagttatgttgtatttggcgggttcgcctccttcgggaccacattaacgccgttcgcttcgtgccaatccattactggcttggcgtaatggctcgaagcgagatccggccggaacagcgtgggaccacggtgagagcggaggaa

SEQ ID NO: 200 - DNA, 32664 bp, Aedes aegypti
gcgtcgataagcgcgtggtgtacgcacgagcctatcgatcgcaaggttcctggttcgattccaggttgctgtgaaagcattttttgttttcaaattttggtttcataaggcaaatttatgaatttcaacccgatttcttgtggcgaattttcagaaggggtccctatgtataccgacattccatttacctgagtgtgtggcaggcacgatgaaactctatgcccagggaagtcaaggaaattttcattaaaaaagtatcctgaaccgaccgggaatcgaacccagacaccttcagcatggctttgctttgtagccgaggactctaatcactcggctgaggaaggccccaggtccttgcatataatcatcgtgtttttcgactggaattgcaatattcattaatgcaatgaaccaatgcacgagttcactaatttgacgtttgagcggtgccgaattcactagtttccatggttacataaataacacggcaccgctaaaacgtcaaatagtgaacccgtgcatagatactccacggacaaaacgtttgagcagtgccatgaaatccaaggcaaatcggatttcgcgcgtcggagattgcggcttccaactggagtcgcgataaaaatgttttattaccgttacgacctaattaaaactcactcctgatgaaccggttcccgcaagccgatcgttttcagttcagtgcattcactgccgcagccagttcagtctgtaccggttcgtgaatcggttctcatctgcgcttttgtgttaacgtatttttcgctccatcgaatgaaagtagagaagattacgaacgcgctctaatttgaaggcagaaagtataattttccaagctgctggtttattttattttgtgaattgtggtgcagtttaccaaatacttgttctggaacgtcggatggttgaaatatctggacaaaaacggaagtaaataggtgtgaatgaattcgactcccaccggtgtccaaacaatggatgcttctgccgttgaaatggatcctctggaggaaattgagtgagttttataatttttaaacagtttgaatcgttaaatactgagagactgttgaatgaatcgatgtgattgccgactttctgatcgttgttcgtttttgtttacctacaggcaaaatgtgatccagcaagcacacgaaataacaacgatttccgtccggaggattcgggagctgtggacggaaatattcgacgagcacatctgccaagaccacatgagccgtttgccggaacacattcagacctttttcgacgaagtgtacgaggaaagcgagggtcgaaagaggaaaatcgtcgatgcaattgaagctttgcggcgcgaagcttgcgacctgaaaaggctcctgcaggaagatccgggcgacttggaaccggtgccgggaacgccgctgcacatgatccagatcgggttggaccggagcttggagtttatgcgggagaagctgaaggtacggcacgaccagatcgacgagtacctgttcgagcaggagacactttgtgaaggtaagcgaccgaaagtgctcttcaaacagggctggtagcgagttactttttagttaatgtttgcaacaaaaagtctccaaagtcaagaccaacaatagaaaggcctcatgctgtaatgggaagtatttatgcacttcaacaaaaaagtaatagcctatctcgatgcgtgggaaatttcttgcaagaaatgctcaagagaagcatttttctttgatcgcagtacgcagttgaaaagaaatgtcaatccaaatgaggctcactatagaattttttttgactttttctttccgcagaaatttttgcttttgcgctgaacagcacacctgaaccatgtaaatgcaaacaaatcaatattctgctaaattcaaattgaaattttatttgttcatcaaaacgcagtgtgttgttcctcaacccatagtttctcaaactgtgggtcgcgaccccttgtgaggtcgtaaaccagtcttaagtgggtcgcgaaacaaaaatccaaaatatgaatttattttcaaagtttttttatgttttctaaagctttggcctctgcttggaacatactcatcatattcttacttaatcattaaaactatttttacaagtgatcagtcattggatcagtcgttactatcaatactattctaaggctaaacatttgaaaaaatattgtagaaagtttcgtcatcaatagaagcactaacagccttctttagttattttttctaaataaatcgtatcaattctacagtcgaagaagaatgctcgcatactctgagataacgccctaaaagccattggtagccacgtgtgtagctcgttgtttctgagcaaatgaaagaataagcatccaaaccaacatcacgggcaggtagataatgatcctttcttccccatagcgttgttaaataacatgaaaatacattgaaatgctcagaaacaacgagctacacacatagttaccaatggcttttagggcgagatcagaagttatgcgagaatggaagagtcgaagggacaactcggcccatggaaatatcgagtaatggaacaaatatttttttgggaaactgattgagaggatcatcaaagtacctgcgaagcatcttcgttgacagcttcagtgataataaatagcactggcacggcctgcttattaacatccagatttaccacatttccttttgtgctttttccgtattgatcaaagcaattttttcagcagatattgctgtgtgcgtttgaaattcaaatatcaaatgcgggaacatcaaacgcggtaagaattttcacaaggaaggcatagtaaagatagcttttactatttttactattttaatttatttattattatttatcttcgtgaagcccaagcgtgacggttcgatttttgcgtcgtcggagaggttttgttctcggtttcgcgcctgttttcgtcgacggagaactttttccctgtttcgcgcgtcttgctgggtaggtgtttggcttgttttcgggacgccaagaagttttgctgttcgcactggtgcgaagagataaattgtgttcagtcgaggatgaattaccaactggtgagttcatttcatgcttatgatattccggcgctcattttaaatccacatccagcggcggcggtaacgcgcagaaaatatgcgcgcaattcaaacgcagcgtcaaaattcaagtaggcttggatttgttcgttcttcaacgacgcaaatgtttcaaatttgctaaatctgaaacatttagtgattttcattatcactgcgacggtatatcgacattgtcagataatcgcattacgttgatttatcttgcagagcacaataacacatttttcttgaaagcgtaactattatgtaatattatgctaaaacaaactttgtatggttcgtcagtataagtgtcggcattatgcttgttttatacaatttcaatatacatatatatttctctttttgacataacttaaaatatcttttgaattgttcgacattgtgaatgttgacgtaatttttaaacaaactatgtatggttcgtcactacaagtgtcggcattattcctgtttcatttaatttaaaatatatacactacccaccataagtaaggaatcgcgtattgcaacactcatactgaatattgcagcaccttgaaaagtttaccatcacctaaaatgaatattattttacgattctgaagtgcaagatcgatgtatttttggagtcgtcttaaaaaatacgtctttgagcccctacaattttttatttttgttggaaacacttttatcactggatgtttggcgatgctaaacttaaaagtgctacaatactcagtattgcaacgattccatacttatggtgggtagtgtacatgtaattttcagtttttgccattaaggtgaagatgaatcgaagccaaacctcgaaattacaagagcacaaatctagagaaccgaacacccgtttgagctgaaaacttaatcgattggtcaccaccagctagtgaccaatcgattaagtttttataatgttgacgtatttttaaatcttctaccaaaaacttctcgagacaaaaatacaaaactagctttaaatataagtcgtatatttcccttcttgtccatgtatcgcatcaccgaccaaaggtgactcccagatctttttcttgctcactaataaacacccttcccgtggtgattgtggagatgcagagttattctcggtctatagaagcaacaatcattatatcctatcattccttcccatcccaactgactgtaaggacttggccggcgccgttattgatcaataatattagatctgttgaaattgcacttcgaaagtaaatggaaactcccattccttattcatttggatcgtagtgcaattcttaccagttccgatcaatcacagagtagcaaccattgacatgtacagtcagtctatgctatgcttattattaatctttattagatagcttttgggtccagatagccgtagcggtaaacgcgcagctattcagcaagaccaagctgagggtcgtgggttcgaatcccaccggtcgaggatcttttcgggttggaaattttctcgacttcccagggcatagagtatcttcgtacctgccacacgatatacgcatgcaaaaatggtcattggcatagtaagctctcagttaataactgtggaagtgctcataagaacaataagctgagaagcaggctctgtcccagtggggacgtaacgccagaaaagaagaagaagatagcttttctttgctaggttggcggtgatatgaatcacggttgctaggtatcctttgattagtttgtgttaccgcgtttgaaacgcatttgaacaatatttgcacgtcaaacgcaaacagcaataattaaagcaacaatgttgcacctacctttgataattcaggttattttgatagtgcaggacccacaacataccaacgaaacaacatttctgttaagtaatacgaattcaaaagtatatagtataagtttgacatttcatgtcagagctcttttcatttcgaaagttttgaggttttacattcaaattttaaaactgatgaggttttatcatttttgaaacgcaatctgagttctacgatcagtatttgctgaagtgttaaatagttcgaacgcttatccttgacagcctagttacagtagaacttaaatttggtctttaatctgtcagagacaagtatttctataacctggggtcatatttgtaataaaagtcagaaatttccattaaacgttaaacgtctagaagtatgcaacgctcatgtatgttacttgattcaattaattttgtttggcatatacctatttaaattaaaaaatcgattgatttacgttgatttttttgtgaaaaaatgataatcaattattattcgttcacatatttaattttataaaaactcatttagaccaatactaatgtttacaaaaaaaattgtgtagtaaccatttttgtagactagcacttgtttgagaaatattagagttgtaatttaataaataataaaatgttttttaagattcgaaatctaatcaatgttttctttagtgaaaattgtcaaattttatttttactttttaaaccatttataataattttgtttaatttatgaattacttagggtgttaagaaagtatgagcacgacttcactatactgccatttcgagaagtgtgcagatacaattctgattttcacacatttaattcccgcactcattaagcccagattttgaattttgagtgatttatttgctacctgtttgtatatgatgtaacagctcctcttatcagttttgcacaaatcgtgagcaactttgttgtaccaattttgtgctaggtcataaagtatgtacaatcaaaatctgaaaaaaaatataattagatgaaaaaaccgaatttagtactataccatttaattccactagagtttgtatcctttgacagatacgcgtatttcgacctcaactgtaaggccgtcttcagtgtcgtgtactagactcgacttgaagaaaaccatcgtatgcacacattatatattaaaactaattccctacccatttttttttaaacttaaaagttatgaacttataggtacattccattccttttttgttgaaactttatatggtatagtactaaattcggttttttcatctaattataggtattctactaaacagctcgaagatttattactaggggtgcgacagctttgcacagagcaacactttgaactcagagcaagcttgagttactcgcatattgctcaaagcaactaacgattgaggacggacctggtgtagtggttagaacacacgcctctcacgccgaggacctgggatcgaatcccatccccgaaatagtcactaaaaatttcagtgacgacttccttcggaagggaagtaaagccgttggtcccgagatgaactagcccagggctaaaaatctcgttaataaagatagaaaaaaaaactaacgattgcttggatctgaaaaacaactgacatcaagcttacgttcgagaagtcaatcattcttctgaattgaattgaattagttttcccgttcagaccccaaggattaattcgacggtattccgaatttggatttctcgcaagaagtaaccaaaacaatttactaaagaccaaatgcatctcccgtttaagaattatttttcactgcaaccaacatgtgcaacgcctggtgctgatataatattagtagttccatgaatacaggaggaaatatccatggttaaggcgcaagagaaaatggcacaaaagtcagaactgaacataacaaattgataaaaataaaaaacacacagcctttttatttgtcaaataaaagagctttgtgtttttattttctccgatttgtctatttaaacagagaaaactgcttttttagtttggacttttgcactatttttactgtggccttaagctaacaaaatgtgttcgtttgttgaaaatagttgcagtagagttgtgctaatgattgataatggttaatcgagaacacattgaaaactcttaccaatttgtttcaaaatgttggcgcatgtctctgtgtgtcattcagccaagaaatttgatagcatactaaaacgatagatttcattgaaagttgatcatatgaatgactgagccatcgaatcgtttaaatttacagtggacttttgctattagagaaagcacagaacacaacagatgacttgccaaagtacaacacccattgagtaggaaaacgtctcttacaaaaagtgttcaagtctaaagcgggacgtaacttcttctcctatacaaatcagttttaaatatatggctctgatagtacttttggaacaggtatttgctctctccgttccagtgaatgtcttggggctcggtttttaagggcctattgcacaggcatcagtaaactgcagactggcaactcggagttcacaaatttcactgccatatttagtgtaacaatgtcttccaaggctttctaccgtaatatccctacgcaaatcatgagggggatttccttgttttcgtaaacacacgaagacatagcattgacggaaaaagtttcgacacaataacgggttgctacttgggttgctaagcgcacatgaaacaagcaatgagagttactcagagttgctctaaacttactcaagagtttgctcgaaagcaaaagctgtcccgcccctaggatttattatgataaaatatgttcagcatcgccgatacgatacatgattagactatctcttattgtattgaaaattaaaaacctaagtatatgaactttgaatagaaactaaaaattctatttatcttatgtaaagagaaaatttagcgatttttaagtttttttccattttgtcaaatgttttctaacaaagccgaataaaattttaaacaaaaattcttgtgaaacatcttggatacaatgtacttgaactcaccacattgaaggatttccataaaaaaatatttagtattagttaagttccaacaaaacacaaacgtttagagtctgtgctggctatataaaaattgattttctaatttcaaaaatttcaatgtagaaggttatttcatcaaacaaaattttcacaagcagcgtttgaaactccccaagaaaaatacaaaaatatttaaaaaagtttggaaaaatattgtgatattcgttatcaaagtcgtgcccataccttctgggacaccctatatggttcatcgaacccaatcaattgtatgaaaacaaataaacaatttgactcaatgattacaacttttttatgcgcaagaaaaaaagtatgaaaataagcttttgtaaatgtttcaatgaaatggtatgtaatcaggtaaaaaaccatattatttcaaaacttagaagagtgttcattttgaacgataacttatctaaataagaatcaagcattcaaaacctcttttaaatgagaacttcgtgagatactcattgctctattttgtcagcaagagaaattttccatatttaggtgttacagtttgctctagaagataaaatatttgaaattgaaacgtaaaacattattgcaaatacgagcagttataaaatatgcgattattgtgtattcatttgaattgtaaagctttgttaaataaaaagtggtctaaagatatgagagacccgttaatccaatataacctcaataaaatacacattcaatgttttcataaaataataataaaacaaattaaaaatttaatattattaagattgataacaatggatgtataaaggaattgttgtaggggaagatcccccagtaccggacacttaagcaactaaattcataactcaaaaaatattggtttcatgtgatcttgttacccatttttgataagcatgatttctcattttttcaactttgtccggcattgcgtgttgtccggtactgtgggatctccccctattcaaattaacattacaccaatattcttaaataatagttctgcttgaatttgtgtcgtgcttgaaaatcagtctatttcctacatgtcaatttcgaaacttcttgagaaaaagatttttatagtcttaatatgtccgtcaaaattatagctatacttccaactcaaaaaaaatctaatccacagcttctatcatccagaaaatctacaaaaatgaaacgttatttgttgcttacacacctgttataaacatttctcgatactaattcgaggtgaataatcttcacaaaatatagtcttaaaacaatgttttgttctttccaagaatccaaatttttctcgcaacgcgaaatattaagttcaaatttgattttcgaaatcaaaattttaacccttgatgtacagtaattttgtatcgatttctccctcccagcaacagtcatttcccattcaatggaaggtacttcagcattgggtaccctacctcatccgatccgactgatttccctctagctttattaagagcatattctagctccttcattgaaaattattcattgaaagtttgtccctgagtgggcagaactacgaaacgctgaattgcagattgtggatttgggttgcgggcgatgaagcgactagagtatcggcgtagagatcgtgaaagtgatccgcaagagcatttacaatgactgttgagtctcttgtggtaatacaatcgattttgagtgcaatgcctttaacacgtagttatgaagtcactatttggtaacttttttggtaatttcagccattgaagccacttttatttaactgacttagaaaactgatttagaaaaatttaacccattacattgtttgcactaaaaacgctttattgtattcaaatatagtcgatcaaagtagtggaaaaaaagtttaaaacaatagcttctaagctcatatccgccttgtaaaaaataaggattgaaatcgacactgttctttcctttcataagagcttatctgacctgctcaatttctcttcatcgatcctatctttcgcttataatgtagccaaactgaataaatttgctatgtttcttagaagcacacgagaaaagatctgtttgttttttgaacaatgcttcagttttaaaatcactatttttataagtttagtcactaaagtactattattttgctatgtgaccactaacagccatactttccatagatttttgttctcattttactttggtttatcattttagagctgggagagatcccgagacagctgaagaaggatcccctaccgtcggaagcagatatctgtgaattccgttcttacctggataacctccgagcggagaaactgcagcgattcgatgacattgcggcaatgcgacgtgagatcaaactgatgatgagccaactggagattgttccgcaatcggatcgccaagaggagttgataaacgctcggaatttccctccaacccggtacaaccttacagatctgcgtcatttgcatgaaatgatcagatcacaatcggaagacttgaaagagaatatagaccggattcgcgacaagttgcaaaatctatggacatatctcgctataagtccatcggtcgtgaagcgattccagaagtactacgactactcgcagaccacttacgataagctattcgccgagctggaccggtgcgaaacccttcggcgtgagaatatccaagcctttgtggatcgtacgcgggttgaaatcgtgcaatggtgggataaatgccttaaatccgatgaagagcgctcgagattctctactttcaaaagcgatgtctataacgaagatttgctaacgctacatgaaatggaactgaacgatttgaaggaattctatcggaacaacgaaatcattttccaacttgtggaacaacgtaaggaaatgtgggaaaagatgatgtcgcttgagcagaagtctaacgatccctccagatacaataaccgcggcggcaaactgttagaggaagaaaaagagcgcaaacggatcaacgttcaactgccgaaaatcgaaaataaactcctggaagcctgcaaacgatatgagaacgaaaacaaacgtaaattcaccgtttttggcgaatgcatcgaagaagtgatccgcgaacagtggaagaaacgcgaagaaggcaaactgcattccagtgctcgaaaaaaggccaacatggcaactccaacagccgtcaatcggacagcgctgacacgaactcccaaaacggcggaagccttggtcagacacaccagcattagcagccgaacgcggaatgcggccggtccaaacgctgatgcgtccgtgaaaaattccgccagcaagttgctgtccgcttcgaaactatccgcaattggaatcaagaggaaacttccatcgcctaaaaccggggccgtcaagcggtcgctgctgaaggatttaaacagccctaggacgttcctcaagcccgggttgccggtgtcggccggtaaaaaccgattgatggtgccgaaatcgcccggcaaaatcccaagcatcaaagtgtacgacaccaaaagtgggcccatagcagcacagaaaagggtaagtttaaatttagtgtgttcatgattatgcagggtttatacagggtaagtgaatgagcaactattcggggctgttacaacagtcgcggatttgtgccgccagtcgcgaaaatcgcgagtaaatgaaatactgttcgcaactatagctgcgaaaatgaaccgggcctgtgaattcaaccctgtttcccgacgctcatttcccacccgtcttatgtatgtaatcacagtgtaaaaatcatgtgcaagtgtgaaggtgtgtgtgcgcatcgatcatccttaccagtcgaccgaccggcgatgcgtgttgcgacagcgaagcttccagaatatcctcgccgagtcggagcgatcatcatcgtcgctgcagcagcgagctgacggttgacgcgacaagcagtgtaccccaccacaggagagatagaaaattctagatcgttcaattttgctataaatatcgatgtggttcccaatgcaattttagttacagtccacattttgaatagttaacatcgcgaataaatcgaagttaagtagtttactcgtgactttccttctccagccgaaccaaacggtctttttcaagaccaaagagttgttggaaataatttcttccgaggttgagctatcacccatcgaggccaccttcaaccgaaggttccgccattccctccaatggtctaggacagaccattttttggtccgtgtcgaaccggataggaaaaccacacccgtggtggacgatcaaccgatcggtccgttccgagtcctttcctcgttgctcccggcaacaatttggtggacaatcagccgattggtccaattccgctcatctgagcatccttccactgttgctcccggcaacatttggtggacgatcacccgatcgtcggaattccagccgtgatcaagctcaaccttgtgccgagttattagaaaaaatattcctcggcaattgtggagaaaggaaatcgtcgcgagaagtatcttccaagtttgtgcgtgcccgtgaagtcgtgtgtgaattcggtccgtcgtttaagtaaagtatcgcggtcgaacaaaagtgaaagcgacacagccgtgtccgtgaagaagtaagtgaaattccaagaagaagaatagtggtgataagtgcaaaaactgaaccgcccatagtgcatcatgtttgagtgtgaaggtctctagttaatgcgtgtgagtgaactgtttcctgatgccaattgaacacacgccagtgaaagtgagtgaagaagtgaagatgcaggacttgaagacgatcatccacctgcgtggccgaacaaaggcgaaagtgacacggatccggaaggcgattgaagaagctgccgcggctggtgcccagtatgatgccgcgcagctgaaagtgttttctcgaaatctggaaaatcatttccaagagtatttgaatcttcatcatcaagtgatgtcagtgtgccctcccgaacgaatcgaagaacaggatcaaggctacttgaattttgaaactcactacaacgaaacgtgtgtgctagtggaacgagcgattcaagcaaaccgtaatattcccgtgatgcaaccacaagtgccaaccaacgagtgtccccggattgtagtccagcagcagccattgaaggcacccatcccttcattcgatggcaagcctgaaaactggcttcgctttaaggctatgtttctggatgtgatgcaacattccaccgactctgattgcatcaaactttaccacctcgagcgttccctagtaggagcagctgctggcattatcgacgcccgcactctcaacgacaacaactacacccacgcttgggaaatacttgaggaccgtttcgagaacaagcgtgtaatcgtggatactcatatccaaggattgcttaatctgccgaaaatgagtcgtgaaaatccgaaggacctgcgagagctgatcgatgaagtgacccgacacgtagatggattggcgctgatcgaggacgagttggatacagtctccgaaaggtttgtggtgaatcttattgctggtgccctggataagcaaacccggaaagagtgggaagcttcaatcccacataaggaaataccaacgtacagcgacacgattacgtttttgaagaagcgatgcgccatcctcgaacgctgtgaaggtgcttctaactctccatccaacgcaaaaccgagtgttccagtgagaaacctatgcaatctggtgagaggcgcacaacccaaggcgtgtgctatcactgggagttccgaagcagcctgcgaactgtgtgctggtgttcatcccaacttcaagtgcgaagcgttccgtgcaatgtctgttcctcaacgccaagcgaaggtacgtgagctgaaattgtgctacaactgcttacgaaagggccatccaagcagttcctgcatttcgccgcgcacctgccagaaatgtcaaggtaagcaccacacactcttgcacattgaaacccaatcaaatgcgaatatccaagcctgtgaaactcctccgacaaccatgtcttcaattccacaagttgctgcaccccctgaagtcgaaccttttccgtctattagtacgacttgctcagtaaacaaagctcctcgtcttgataacagcctcttgatgaccgctgttgtaaatgttctggatagcagtggcaaactccatccttgtcgtgcctttttggattgtgggtcccaggctcatatggtgtccagagagttggtcgattcattgcgtctacctcgtacccctgccaatgttgaaatcattggagccaacggtaagaagtctattctctctgaaatggtcaaggtacaaatccgttccaggcattctgattctgatttcgaatcacagttggagtgtctcgttactgatgagataacaggcgtgacaccgtctcgtaaatttgatacccagtcatggcttctaccatctggcctcccgcttgccgatccaacgttccacactccaggcaaaatagatcttttgattggaatcaaactcttcttcgagctgttgttgcctagtaggctgagaatctccgacgaacttccggttcttcaggaaactcgtttaggatggataatagccggtgctgttgacgatgtggatcccttctccaatcagcagcattgtaacgttattacgctgaaaccgcgtattgaatctttagaagcttgtctcgaaaatgttgaatcctctgcaattattgacgaagagccagcccaatcagttgacagcaagtccaatgtacagccacgtgaaccatttaccatccgtgataatgttgagtttatcgctactgagctgacacaacccgaaaatctgtcatcgagtaaagtagctaatccagtcgcaaatacgtacccagctcaattccatcaagttgaagttaatccaatgctgttgccgactcctatcggagttgatccgatgcagaagtcgtttccaaaactactcgaatctcatccaaggtttgagccaacctcaataaaatccgaggcacaaccggtgccccaggaaatccagaatattcccagctatcgtccaaggcctcagcatttctcatgtgaatttcgtacgatgaataaccgattctcgaatgcgatgatcacgaagcgtttcccttgtaggaccggattttacccggtctcgaagttaccatcgttttttactagagtccgcccagtgccacagcagtttccgtatgtgattggatgccatccgtcaccgaggcatatcttttgtttcgccggaccccatgccataacgaagagttcccaacgtgcgaagaaagtatctccgtttcatgagcagttcccatatgcggacagatttcattttctgttgaagcagtcgctccacgtgtctgagttggatccgatgctgaaacagtttccagttgctatcgattatcatcccgtactggacaagcctcctgatgtagccgaaaccctaaaggtatctgaatcattcttgattccacgcgcaatcaccccggcatgcaatatgcaaggtaagcttcgttcgacatcaaccagagtcctgaaggtacccgagcaggttctgatacctcccgatatccacatcagccacctgtattcatcaacgatcgcataacgaacaccggaaaaacccaccgaagccgaactaagcgttaatatgtagaagataaccaggattgaagccactttaaattttccgcccgatgtttaacctgagatactcccatttatgaccatgacgattattgattccactgtgcaagtagtaaatgtaccatcgaccaccagtatgtatcgttgtttagtattcaagttggctccactcccatttgagtccaaatcccacaatcaagtcatacttctgagctttgcccggggggtgaatgttcgcaactatagctgcgaaaatgaaccgggcctgtgaattcaaccctgtttcccgacgctcatttcccacccgtcttatgtatgtaatcacagtgtaaaaatcatgtgcaaatgtgaaggtgtgtgtgcgcatcgatcatccttaccagtcgaccgaccggcgatgcgtgttgcgacagcgaagcttccagaatatcctcgccgagtcggagcgatcatcatcgtcgctgcagcagcgagctgacggttgacgcgacaagcagtgtaccccaccacaggagagatagaaaattctagatcgttcaattttgctataaatatcgatgtgtttcccaatgcaattttagttacagtccacattttgaatagttaacatcgcgaataaatcgaagttaagtagtttactcgtgactttccttctccagccgaaccaaacggtctttttcaagaccaaagagttgttggaaataatttcttccgaggttgagctatcacccatcgaggccaccttcaaccgaaggttccgccattccctccaatggtctaggacagaccaaatactaaaatactaaatcactttgatactttgagtagtcacgaattactcaactcttcaaaaaattgtgtaatggattgatagttgaaccttgatatagttaaaacctaaaagtttcaaacgtactgaagatctgcgagttcgtagcgctgcaggaggtgtgctggaaaggatcgatggtacgaacgtttagcggtaaccatactatctaccagagctgcggcaacacgcatgaaacgggaacagcttttatattgatggtatacagaggcacgtgatcggttggtggccgatcaacgaaggctccgggtcttcaacttcagcatcataaacgtgcttagtccccactccggagcactgatgatgacaaggacgcattttacgtgcagttcgagcgcgagtacaatcgctgcccaaaccacgacgagatcatcataggagatttgaacgctcaggttgaccaggaggaggagttcacactgacgattggaaagctcagcgctgacaaatgagaacggcctacgactgatagatttcgccgcctccaagaacatggccattcgtagcacctactttcagcacagtctcccgtatcggtacacctggagatcatcacagcaaacagaatcgcaaatcgaccacattttgatcgatggacggcacttctccaatataaccgacgccagaaactattgtagcgcaaacattgatcactggtgaaactgcgcccaaaactatttgtcatcggcaatgtacggtatcgacgcccgccttggagttctgtttgatctttcgaccttgatgcttgcttttgccggagcgagcgacaagggcagaatcaaacatgtcgcgcgtcggtctcgtaagtgaaaaagtggcgtgatcgggaagttcggttggagtaagtgaaaaagtgccgcgatcggttagttctgtttgatctttcgaccttgacgcttgcttttgccggagcgagcgacgagggcaggatcaaacatgtcgcgcgtcggtctcgtaagtgaaaaagtggcgtgatcgggaagttcggttggagtgagtgaaaaagtgccgcgatcggttagttctgtttgatctttcgaccttgatgcttgcttttgccggagcgagcgacgagggcaggatcaaacatgtcgcacgtcggtctagtaagtgaaaaagtggcgtgatcggggagttcggttggagtaagtgaaaaagtgccgcgatcggttagttctgtttgatctttcgaccttgacgcttgcttttgccggagcgagcgacgagggcaggatcaaacatgtcgcgcgtcggtctcgtaagtgaaaaagtggcgtgatcggggagttcggttggagtaagttaaaaagtgccgcgatcggttcgttctttttgatctttcgacgaccttgacgcttgctcctgggcagtgcgtcaagaaagcccgagctgtcgtccgtgtttttttttcgagtcgcgcgcctttttttttttttttttttttttttttttctgggtgctagccgagcaaacgagtgaagctgaaaatggattgtggccgctcagtcaaggataacggatcaattggtgagctcgtttcatgctactatttctaatctataaaatatgtatgactgcacatttaatcgttacaatggtgggatgtaaatatgatgtttcaacaaactatggatggttcgtcactgtgagtgtcgacacaaactctgattcatgatttatttatgtttaacatttttttttcagaacaccccttatatacctttatttttgtaattaaaaaaactttgaatggttcgacactacaagtgtagacttgcgaaaggtccactttattcaacaaactttggatggttcgccactgtaagtgtcggcataagaataagagtgttctatgatgtcccaaccaattgagtcttttgtttcttttcaaatgagtaaaatataataacacatgctttcgtactgacagctgtaggaatgttacatttaggtatttgttcaacaaactttgaatggttcgtcacctcaagtgtcggcataattttcctctacatagaaattatatgaacaattatatttacgtataagcatgtatatatctcacaaatcattgtttatcatggtctaatcgcttatcaaagtgaatcctttgacccaacgatcctccccattaacaaacatccctcccagtaacctttgtggagatgcagaggcaaacacggtctccaaatagcaaaggttacacactaacattccttccctcaatcccacctgactgcaaggacgtggccggcgccgttattgaccttgtataaatagaggcactgaattatgcacactgaagaagattatggcctatcccagctgaacttctagttgattctttgtgcattttcactgacttcggtcaatcacggaatagcaaccattgatatgtgtagtcagtctaagctaagctaagctaagctaaggcaatgtacggtatcgacgcccgccttggtataatctagcacgtctgacacaaccgaacgtcgccaccgtatacgagcaccatctcgtggtaccgttgtcgaaagagggagagcttattgaaacccctcttgacaactgctggagtaccataaaagcagaacgaaaccgagagcatcgtcgggtacgtagaaaggaagacatgtaatgattgattcgacgaaaaatgcaggcacgttttggaggagaaagatgcaacgcggacagcaaagcaggagcaaggaacgcgaataaacgtggagcgatataaaagcagcaaacccgcttatttcgggacaacaagcgccgcctggaagaagcaaaatgtagaaaaagcagctgcatcgttcacaagaaacgcgatgttctatgagaagcttaacgcattccgaaaaggtacgaagttcctgcgaaccgaaatatgtagggataaggatggaagataggagggtctcgtagcctcgaggttacgctttcgtgtcgtaagcagaaggccatgggttcgatccccaatccccccacacaaaaaactccatccagccactagaagacgccgcacgaaggacagtgtattggggaacacaaccatcctccgtcagtatcggatggtgactgagacacactggccctctttgtaggctgttgcctcacacgacacgaaaacatggcaaaatgaaccaccgcacaccaatgcacagtggtccaggaatcagttttacgcggaaagatgcattttgagctttagaatgaaacattagacaaaaacagtcttcaacaaagttgtttgttttagttaagccttttgtttggttttattgaaaattagggtggaccccattttcatagaaattgtatacctaactttcttatttgtagaaattatattatacatgcttcagcaaagttatataccatttaatttcaagcaactttgccaaaaaaagtttttttgtatctcttaagttgaccgatttagagctttttttctgcatcgacatagggtggtccgaacaaaactggtttctggctctagagttttcaattcaaatttctcatcaaagtagtctatgaaacacttttagagctttaaaaaatgcgtaatttggtgagtgaagaaactcgctaccttcttccgtttaggagttattgttgtttttatctcaaaaacatgcctactttgattgtgaatatctttgattggggcaaacataaaaaatatcttttgacggcattcaaaagacaaaataaaattgaatactctatcaaaaaattacagatgtgttatttttgtaactctaataaaatgacttgaaaaattaaggattttaagcagaaaaactttaataacttttgaataaaaatagatatcaacaatctttttgcatgaaaatttgcgttttgttaagttctaaaagtcgtttatagaccgctttgacgagaaatctgaaataagaaagatagggctctaaaactattttgaagattttcatagtatgtatttctttattattttgcatttccagcatgaaaatgaaatgttagacaaaaatgatcttctacaaaattgttcctaaaaatgtaagctttcatactgtgtcatctgaaactagggtggtccacaatatcacataaataatataatcaacttttttatttgcaaaagtactggtatatgctcttaggcaaagcggtagaacttgaaattttgatcagctttgccaaaaaggtttttctgtagctcaaaatttgaccaatctagaacatttttcctaatcatcgcagagtggtccaacaaaaaaaagtttttcaactctagtttttcaaatattattttctcgtcaaagtcgtctatgaacgacttttagaacttaacaaaacgcaaattttcatgcaaaaatattgttgatatctattttggttcaaaagttattaaagtttttgtgataaaaaatatttgattttcaagactttttattagagttacaaaaataacacatctgtaattttttgatataatatacaattttgttttgtcttttgcacgccgtcaaaagatattttttatgtttgccccaatcagagatattcacaatcaaagtaggcatgtttttgagagaaatacagcaataactcctaaacggaaggagatagcgagtttcttcactcaccaaaatacgcatttttcaaagctctaaaagtgttttatagactactttgatgagaaattcgaattgaaaactctagagtcagaaaaccagttttgttcggaccaccctatgtcaccgtaggaaaaaagctctaaatcggtcaatttaagagaaacaaaaaaactatttttggcaaagttgcttgaaattgaatggtctataactttgcttaagcatgtataatataatttctacaaataagaaagttagttacacaatttctatgaaaatgtggtccaccctaattttcaataaaaccaaacaaagggcttaactaatacaaacaactttgtagaagaccgtttttgtctaatgtttcattctaaagctcaaaatgcatctttccgcgtaaaactgattcctggaccatagtgcaatggactacggctatatggatatggattggaccaacggcagtactctccttcttcttcttctttctggcgttacgtcccaactgggacaaagcctgcttctcagattagtgttcttatgagtacttccacagttatcaactgagagctttctttgccgattgaccatttttgcatgtgtatatcgtgtggcaggtacgaagatactatatgccctgggaatcgagaaaatttcctttacggaaagatccacgaccagcgggattcgaacccacgaccctcagcatggtcatgctgaatagctgcgcgtttaccgctacggctatctgggcccctgcagcactcttctctgcctgctcggtatgagagaaatagcaataagaaataaggatttaaatagattctgtagctgtgtatctatagaaaacgaaatgatagtcggcataacaaataaaagtaaggaataaaaaaaaggatggaacatggaagcatatcgactgtgtatgacgagcgtaaacaagtgttcttgtgttcaaatgtcactaagccctaaagcaaatgagtttgtgggaagttatcaatggccgctcgacggcggaccatatcttctatgtacgacaaatcctccagaaatgccgtgaatatcaagtctcaacgcattacctatcgactggtgtcgaccttaaagtggcttatgttttcttgggaatgttgaagcaatcgaagcaatatttgatatattcaacatgattgcgttgctatgtacattccatagcaacgacctttgtagtacatgaatctgaaataaaatattcattagtagttcgaccattaactacaccacacgtgtcaagccattttctctcggaaaagtcttccctgcggcttaaatctccaataggttattggtccagccggaagctcctgatcgaaaaatttaagcgtgaagagtttgatgttgttttacgaagctatggagtggacgaaaattgttaagctgaacaattcaaactaccaagtatggtcattcttcgtgaaagcgttgttgcggagggagcagctttggaagcacgtggaaccaggtactcctccggaaccgataacggatgcgtgtaacgaaagcgacgagaaaacgttggaaacgattcacttgttggtagatgagagccaatacaccctggttcgtaacaagacgacgacgaaagacacctgggcggttcagaaaggacgtcacgagaggaccacgttggggtaacgggtgaccctactcctgggtatttttttaaattatcggacaggtttgggccggaggttctccgatttgcatgaaattttcaccagaggtagagctcgtggatacatgaccaaaagtgaaattcaaaaaaattatagtggcctattttcacgatttttctatatacctcaaactttgaaaattcatatctcctgaactatgcattgtagaacaaaagttttttagtgaaatcgaaaggaaattttctcagcaatctattaaaaatataaaaagaaaaacatttctcggaaaatttttcaccatggagaaaattgttggaaaaatagcgaaaaaactatcgtctgtatcatgaaaaattttcaaaaaaatattttttgtttcatcaatccatactctaactttcgtccatagacgccaaagtggtatcttttaccgtttaggcgacagaactgaaaaaccgatgaccacccgcacgcttcccataagaaaatgtgttctattgtgggcctcataaccgtgcgctaacggcggtagtaatttgcacgcattgaaagtgtaacacagtaaaccatccttttctttccagtcagaagaagcttttcgtcaatcggaccactctccattggttgggttgggtgttttgtgtgctcttcatcagcaacgttatttagtattaaagctaacagcctttatgaaagccgcacgggaagttcttgttacaatcattcattatggtaacatttgaaggatcaaatctcaagatccactttctttgaaaacttatgaatatattcttaatatgatgtttcggccaggacgtctttcctacgttgtgtcttttacgatacaacggacggcaaatcaagcgaacagcttcacagatttattaccactgagaggcagcatgcatactcgtaggagaaacgaaaggaactacattcttacaaattcaataggtgcgccttacataggcgcactatacggccagacaaaacatacaataattattcattacgcgcgtacgcttcttcaaactgtatttggcgcgctgttgggttggcgccaactgtagaggctgcacgctgactggcagtggaatattccacagcagccatcaatggaacaatagatagcgtctctgagtgttctacagttaattgatattatatacatgcaaatactatactttattcttccaagcaacaatcagaattaatatcaaatatatcactttgtattgaaaacaaaactgaaaatttattcgcgctcttagttaattatctaatttgataaattgaacaaaatttgaaaaaaaaaagcaagacaattacaaatagcactttatgtatgcataaatatcctttttgcttggcaactatatgatactgagggtcaagcatgggaaacactcactcagttattgtgtttccctcactcgcttccacgcacagtcgggagcgagaaagccgttttttttaaccaagccgaacgtttcaatttccagtgcccattctgcttcttcggcgagcactaagcgaaacaaaaaacggcatctgatcagtcgaatgcaatgagcctctgtacgtgccatagattcttttgttctcctgacttttactgtgcgccgtgtgttggtgatgtctcgctctctctcacgggcaacttgaaaacagggcgcacagtaaaagtcaaacattttatagcatgcataggctcataccaaaattcggacaaaggacaaacatttgaaaagggcccaagaggtcttgagctttttttcagaaacgttgctgttgagccctttttagcccgcccacgcaaactaaccccactatcagaaagattggtgttagctcttcctaatagtggtatgggtgagcgtgatctagttgaattgggttcaacagcggcttgcaaagccaatgtttaccaatgtcgatgtgcatttttgaaatgtttgtccaggaatgattgtttacattctgattccgttcgaatggcattcgggtttgagtgctaatgagcgttcactgactggcagtccacaccacggaatgattcagtgagtaggaatcctctcagtcagttcaatgcattcggcgaatggatgctaagtgcattaactcgtgcctcgcagatacaagtgtattggtattcacttctcttcgcgttccttccgattgtcgcttttacacaatcggttttgacgctttcatgcaacactccgcctaggatggttcagctatcactgaatgttcgatagcagcagattttttgctatttttcttcggtggcgtttgggtgagtgagtgaatttttccatgcttgctgagggtcagttcctattatctatattattaaatgttaggatcgttttcaattaaagactgttggtctcaatagtaaagattacgaataaaggacatacaaaacacccaacagaccaaagaagagtgctccgattgatgaaaagcttcttctgactggaaaggaaaggatggtttactgtgttacacttacaatgcgagtaaattactgccgccgttagcgcacggttatgaggcccacaatagaacacattttcctatgggaagcgtgcgggtggtcatcggtttttcagttctatcgcctaaacggtaaaagataccactttagcgtctatggacgaaagttagagtatggattgatgaaacaaaaaatatttttttgaaaatttttcatgatacagacgatagttttttcgctatttttctgacaattttctccatggtgaaaaattttccgagaaatgtttttctttttatatttttaatagattgctgagaaaatttcctttcgatttcactaaaaaacttttgttctacgatgcatagttcaggagatatgaattttcaaagtttgaggtatatagagaaatcgtgaaaattcatctagagttttccgggaaaataggtcactatattttttttgaatttcacttttggtcatgtatccacgagctctacctctggtgaaaatttcatgcaaatcggagaacctccggcccaaattgtccgataattaaaaaaaatcccctcctcgaaaattcgtttttgagatgcaagagtgcctcatggtgtcgctgatactgctgggacttccggagttattcaatcctctgacgacgacactggaagcgcgaaacgaagatgagcttaccctggaccttgtgaaggtaaagctgcgggatgaagctgagaaagtacggaaacgatccggttccgacgagcaagtgctgtgaactggctgaacgagtgcgtcgcagaaaagtatcgtctgctatcactgcggcaagccagggcaacgaaagcgaaattgtaaggcgcatctggcagagtatggcggaaatacggaaccgaagagagaaaaggccaaaacagtgcacgaaaacgacgcatgatgcgattgcgagggtgctcgattcgggcgcgacgatagatttggcgaaaaacagcaatttgtttgtgcgtctcgagtgatggtgagtaataagcagcacaacattaattgtctgcactcgtggcatcgacgactaggccaccgagattcagatgcgattggcgaagttgagcggcgtggtttggcttctggaatgaaaatcaagccatgtggtatccggatgacttgtgagtgttgcgtcgaagggaagatggcacggctgccgcttccacaagcagccgagaaaaaatcaaaggcggtgctagatatcctgcacagtgatgtatgcggtccaatgacgacaccgccgggtgggtgccgatattatatgacgctgattgacgattacagccgttatacgatcgtgtttttttttttttttgaagagaagtccgaggtcattgaaaagatacttgaatatggttcaccgaaacttaattcggaaggaaaccaaacgtcatccgtttagaacggggtggcgagtacaccagcaaagctttgcgtaagttttacacagaggaaagaatcaaacagaattcaccgctggttacgctccacagcagaacgtctagccacgctgtgtgaacaaagaaacagaacgcttaaacgaaatggatctgtgtatgctgttggatgctggcttaccttattcgtttttgggtgaaaaccagctgccatcatcaccgatacgatccactccgtacgaggtctggttcggtacgaaaccggatttgcaacatttgaatgtgttcggttgcagtgcctacgtgtggattccgtcacagaagaggaagaagtttgaagagaaaacggccaaatggacattgctgaagacctctactggccaaatagtcatcagccgtgacgtgctatttttggaactcgacgatgaggataagaacgttaagggtggaaccatccgtagtctaccaggatagttccctaacgaagacgaacagattgcagtttgactgtacggttgtggacataatgcggaaagatgcgatgattctcaagataaagaagaatttttcggattttacgatgacaaagatgactccaacgaggcagtactagtgcaggaggagcacatagccgttccagttgctcgtgattatctgcggcgctcgcagagggaaaattttggtttacccccagagcggtataccgacagaattggccttgctgtgaacacgtacactgagccaagtgcatatcgaaaagcgtttgagagccaggacagtgaaaagtggaaagcagccatggacgaggagttagcacctcttcgagacaaagagacgtagacccagaggcgactcgtaacctcactttttacctgttctacgcatctaaaaatgcctttttcggcaaattgagatattaaagcaaatagtgaatgatcggaatcttgctttctagcgtatcttaacttgatagaagcaaattggttgcgtaaagtcaagaatgtctattcgtgaaacaggtagatttgaggttagggaaccgccactgcgtagaccattacaaaggcaccccaacggcgcaatgttgttggctgcaagtgggtgttcaggtgcaaaccggacgaatcgggaaaactgtgcgatacaaggccagattggtcgcacagggtttttcccaaatatatgaaactgattgcggtcaggtgtttgctccggtggtgaagcaaatcacattctgtactgtgctgacaatagcaagcaaacgaaaaatgctcaacaagcacattgatatcaagacagcgtatctgtatggcgtgctgcaggacgagattttcatgaagcagcctcctgggcagtcttcaaaaaatccctttccaagagctgctgagatttaaaatcacgagagcaagatttgtttcgcgcgcatttttggttcaaatccaggcatgcaatgaatcatgccacgtgtatgggaggattgaatcccaggattcaatccttgatcaattgtttgatggtaaaataaatcgagtcagcattgatatttctggcgatgttaactgaaaattcctgtcagacaggacgtttgggatgagtctatcgtcagtttctgacagccttctgacctaaacatatgtactgaaattacttcccatttagatgggaccgcttgcttttaatcagagaatatgaataaaatggtatcagaattttagaattgacatccgcaagaccacgacttaatttaccaatcatagtgctgtgacggtcaaataatttgacttaaccaaggctggtaacgaccttcagtagagccaactagtagggtggtttgatacaactcttggacgtttcagatgacctatataattttattgctttccatagtactgcgctttctcgttccataggctcggtgcttcccaatccccataggaacgtcgaatattcatattggacacgaggaacatttggactatttcattcggggagggtgctgtattcttatattcaatcaatctccagtgcgcttcaatgattcaatcctaagattgaatcctggcacaaatcccgcacgctgagattgaaaaaatcaggattcaaaacgatcccgctcattgagctgaattcaaagcatgcttatttgaatcttggagcagaaggatgatcttagaagactgctcctgggtaatagaatggcgatccgcatatcgtgtgcctcttgacacgaagcctctacggactcaagcatcaatctttggctgactcgtgtctctatatgcggatcgtgaatggtatgaaaacgtacattttgatgtatgttggcgatatcgttgtcgtgtgcagaacgaaacaagaataccagaaggtggtcgcggttttgagtaagagtttcaagattgccgagttacataacttgacgttttttctgggaatccacgttagaggtgatgctgaccgattcatcctaaatcagaaatcgtatgtaaggaagcttttattgcggttcaacatggctaactgcaaagcgtctcgatttccgatagccagcggatttgttcaacaaaaggaggagcatagtgaccagggttgggaaaatcttgaaattcactctacagtagccaagcaacgccaatcacagtcagcgaagccagtgaaactcacgcccatcgctgctgtaggcaaaatgccttgaaaatagcaaaacacccgttgctaagggcaacccagaattactgtggaaaaatgttctatttcccgctgcatttcccgcatttagagccttcaatgacactcatgatttagaaaattcgtgcacccaacataggctacttgatgagattcacgtttttgaactactgtactggagagccacgtgattttcgcgaaaattcaagcctactactattaccattcccagcactgatagtgactcattggcagatggacaagtaccaaagtctgatcggtgctttgttgtacattgctacatactcgggtgccggattatcaaaccaatcactgcggtttggaacgaggcgaatcgggtgctacgttacattaagggcaccgataactacgagctccatctgggtggtggtgacaaccttcaagtggagtacttcgtagatgcaaactgggatggcgaagtagacaacaggaagtccaacactggctatattttcaagtttggtggcggactcgttggctgggaaagcaggaagcacacgtgcgtgtctctgtccagcattgaagcgaagtacatcgctatagcggaatgcttgctagagctgcagtggctacgtgtactggtagataaccagagctggatatggtatagatcgtgatagtttgtcatattatttgttatggctatatcggtcatccaactcaaaggtacagggagtatgtagaagatttttacaaatgataaaatgaatatttggataggcataccagtgttcgtaccgaagctcaaagctttgtttagagttattattaattttatgcaaaacataaatcacccgaatgacttgataccgttgtagtctgtgaaagttactgctcttgaacgctatctcgccatataccaaacgagagagtgaatatcaacattcatagctctccgattgcaatgtgtcacgaactgttatggttcatgaactgttacactctgaatatggttcaatcggcttattcggatcaaaattcaaacactgaattttacctaacaatcaactaatgactttataaataacactttcagcgatcccgacgaaaatctcggaacagatcacgtcgtagtgttaacaaggcccgtccagacatcgtaatcacatcaagtacaaataccacacttcaatcggaatccgtatcgtacgagcattttgaggtaagagctgaaatttaaaaataatttcaaatttgcgatttcaacctaacatttatctttttttttatcggcagaactttttcgagaccaacactccaaatcgatcatcgctcatgcccggtcggggggaagcggtgacggcagaaacccgtgccaacacgcgtcgtcagtatcgcaatcacggaatttcacagctcaacgccactggaaatccgctcagcacaccgtccaagataacgttccggaatccgacggcttcgtccacgatgctggccactacgttacgatccccggcagcaagcaatactaccgccagcggcaaaaagatgatgtctactgctaagaattgtccgatcattttctaagctcgataagatgattgcaaatcatccgatcgatctgtggcaccctcatccgttcaacgagcgtttcgaagggttggcaatatgttacatgttacgttgttctaaagatttttgcccatctcactcggaaccataagtaggtagtagccggtaaggtatttaacacagtcctttttttcgtaccgctttcgatttacgtccttatttttgtatcataaacatatttttagttatttgattacaagagaaaaacaattatttttagttaatttttaacacgcttgtgatttgaataattttacggcaaacaagaatcgatttatcgaataatacacacacgcaggcattacgctctctgaaatctaaaaataaatttgcttgaaaggtttagaataaagcggatcggatcgtagatcctgttctctgtacaaagttcaaaaaacaatataagacccgttttctgattattaataaatttatattttaatacaacgacatcgacacggtgctaagagataatctttttgtaatagatgacctaacatccctgcactaaacaagaaaaagtgggtatctttaatacttaagctatttcaaatctcatcaaaaaaaaatgaaacaccttttaaaacatattattgaggtctgggaaatattataagaataataattcgtccttggtggaacagaaatccttgaaagagtttgctaaaaatatatgatgttaattttggagggtccgttgagtgctggcgaactccttcattcaactaccaaagtaatgtctgtcgaaattcctggagaaagccttaaatgaatgcctttatgcatttttggagaattttattgagaaaccattggagaaatttctggaaaatcctttaacccacttatgatcaaatttttatttttgatttaaatatcatttttcgttatctaaaatcaatctaagcacgtttcggataatggtttattttaattcgtaaatttataaatattggtttttgattttttttgaagtcccttttttcatattattcatattgcgcatttccttcaccactggactatcgcagaagtttttacaagtgcggaaatgctaataaaagtgcgcgattgcagcaaatcgagtgagttattcctcacagtccaacgaataagtgctctgaagacaccaacatgattcgatgcaatcccgcacttttatttgcattttcacacttatgaagccgcacttcgaagtccagtagtgaaagaaatacacaatattttagttaccgatttttgacaataatgaaaaaatgagttacaactgtaattttgaaaatacagatcggactcgattatccggagtattgatttttttttcactccggataatcgaaccactaagaaaaaaattgaaatcttcgataaaagaacttaaatattatctttttttcgtcgttttatttatatgatgcggtggcgtagccagaaattatttataggaacagtaggggtctttaca

SEQ ID NO: 201 - DNA, 5830 bp, Aedes aegypti
ggtgcagttcttaattctaccatggattcggtagattatacaacaaaaattgtttgcgagtgtactcaagctgtcagagcgtggcaaactagatgttggtcacacgaacagtcgcgacattagcattctaaggctaatgcttctactgtgggtgtcgaaaataaccacttttggcgttatgaaatttgtgaatgaacccttaaggccgcacgggacgtcatcataatcaccttatccatttcaagaagcaaatcccaagaaccactccatatttcgatgcgaaaatatgactataattctattcgtgatcaaacgtcaacatcccaccgcaaaatcgctagtgtttggaggtgattttaacctccaatttgccaaataacctccaaaacatcacctccaagttagttctaataacctccgttatatgaaatatggtggcgcgtcgatcgtggcaagtttatcgttaaacagtcaatatatgcagtgcacaacccaataaattttcagctttatcggttcactaaaactcgagatttgcttccacaaagttttgatgataattgttagagtgagacgaaagatagggaaaataacacggtctcccgtgtcgccttaagtaacacaatctgatttcaaccctgcaagagaaaggcaggttgctctcacccctgccggttccagtcagctgtttttgtttcgttccactttcccatccgttcctctcattgacagatctctgaaaccagagtgcaccgctggaagaaaaacagctgtgttttttcactcccaacaagcattttgcatccttctggtgctcgttcaaaaaatgctttgaattttctcaaaatcgtggaaattattccgaaagtgtttttcgttgtgttattagtgtattcctccttctgttaaccgtgtcaagtgctcaaataaggccacaaaatgatgggtttgtatcaaagtttctttcgcttttctcgccctcccaagagactcatatcggccatgttggcattgagcaacaaaatgcataacaaattaagcgatgaatgactcatgcacttctttctaaacgattttattctcctctgtgctctttgcaggttgttgtggctgctgctcggccctgcggcctcgctacaagcgcctggttgacaacatcttcccggtcaatccggaagacggactggtcaaatcgaacatggaaaagttgacgttctactcgttgcgatcgccggagaagctggacaggattggggagtacttgtaccaacgggcctcgaaggacatcaaccggaagcggtacaagttcgtggagattgccatggaggcgatggatttgctgctgatggcttgccatgcgcagattctgaacctgtttgtggagagcttcttgcggatggtgcagaagctgatggaggatgtgaatccgacattgcagattatggccacgaattcgttcgtgcggtttgcgaatattgaggaggacacgccttcctatcacagaaggtacgatttcttcatctcgaagttcagttccatgtgctacgggaataacgacgatttggagctacgggacagtattcggatggccggaatcaagggattgcagggcgtgatccggaaaacggtgtcagacgatttggtggagaacatttgggagaagcagcacatggagaagattgttccgtcgttgctgtataatatgcaatcgtcgagtggaagcaaaatcgtggaccaggaagcgactccttcgacgccaccggttctggcagaggccgtgctcagagagttggtttcgagggcttcctttggacatatcagagcagtgctgaagccactgttgatgcatttagataatcacaagctgtgggtgccgaatcggttcgcaatcgacaccttccggatcgtaatgatctccattcagccacagtattcatacacggtcgttgaaactctaatgtcccatctggatcagaatctagcatcgtcaccaaagacacgaacttccctcgcggttgtcctttccaagatcatcgccatcgcagcgggcgaaagcgttggaccatccgccttggacatcatcaacaatctcctaacgcatctcaagacttcggtcagcacccagcacgaatccacaccggaagagacccaataccaggaagcattgatcaacgccctcggcgagttcgccaatcaccatcccgactaccagaagatagaaattatgctcttcatcatgaacaccgttccggacccctcgaagaagaacaagggcgatcagctcctccaaaacatccttctcaaatcgctgctcaaagtcggaacccagtatcgcaccgtgtctttcgaaaaagctttccccgtctccttcctgcaaccactgctcaaaatggctcgggcttcctcggttgcgatccgggtgatagtcatgcaaatcttccagcaactgctcgatcgccaccaaaatcagcaccttctgaacatgatctccgtcaccaattatccgacgctgacggtggagcaagcgtcccgatcggatatccttttcacgcacaagcacgggtcgaacattctgcaggccattctggacggaatgtcccaggagaaccatatggaagtgttgaagtcgtcgtacaataccgctggcctgatggtggtggagatggcttgcagcgaaacggtgcaggagtttctgctatttgtgttgaggtaggttcttgtggttttttatgtatttaacctttgcgttctgggtctatttttcataagttccatgaacaactttattgccaagccaactgcaaccgggtctaccccgtttggcataatgccatttggcatacagtcgtttggcataacagtttgtttggcataatagtctattggcataatgatcatttggcataatttgaaaaaggaagatactgcagtggtacagtaatatacgggaccataagatacgtcataaaataccatgttccttttttcaattgacatggaataacttaggcgttggatatatttttgttaaaaatgcgctctaatatcccggacataatgaccccggaagtcatgtatgatacaattccaaaagagctttattggatattggtttccttgaaaaatgaggattagaagtatgttctatcaataattgacaacggaatgtacgatcgtgagcagtttatacacacccctttgcttaatcgaaggaattcgattatattcaatgtttttcacaattatgccaaacggctattatgccaaatggcaattatgccaaacgaccgtggcattgtgccaaacagctattatgccaaacgactgtatgccatacggcattataccaaacggggtagacccattgcaaccgtaggttccgatttatcttaacacggatgttccgtgatctgtccgaaggtcatgagtcattttcattttgcacggattgaaacaaactacagtgtttgtgggtctgggtcatttggcataaggtcatttggcataacggacatttggcataatatcaagccatgtgtaaagtaagaatcatttggtataatatcaaaccatgtacagttttattttcatcgatttgctaattattacggagaaaactgattctatgctgaccctttacttcggccttaaataaaaaactaattacaaaatgctaaggctcagatagccgtagcggtaaacgcgcagctattcagcatgaccatgctgagggtcgtgggttcgaatcccgctggtcgaggatcttttcgtaaaggaaattttctcgattcccagggcatagagtatcttcgtacctgccacacgatatacacatgcaataatggtcaatcggcaaagaaagctctcagttaataactgtggaagtgctcataagaacactaatctgagaagcaggctttgtcccagtggggtcgtaacgccagaaagaagagaagaattacaaaatgctattgcaccaacaaaaaaatgtttacattcaaaagtttattaatgttgtctagctaacacctaactattttttttctctaaagatatcacaaaacttatcctcagttcagaaaacttccaatagttatgtggtaaaatttcattgcaatcggatggaattgttacttgagcaaatttaacttttgtctttccagcgtccaacaggtggccgtagccgaagtggaattatcgcctaaacaccgctgtaacttgcatagcattgccatttcgatactgatcctgattggccgctgtaccggcatcggaccgcttgtggaatacgccgaaaaagtcatccaatctcgtacggaagatgcaccgtatctgttgccaccgttgctggacaatgagaaacccgcacctagcaccctgaacaccaatcagccccatctgatgatagacaagttggccgtggcggagtgtctccaacaggccggtctggaacataaccgagttcagacgggaactccttactccctgaaccaaacggacatgtccgctcatcgccactcgtgggtcgacaccagtaagtatattgaactgaaaatgtccgtccatttcatccctgactaacaaccccggatcaaatttcaggtgccccccgcaacagcattgttgacgccaactacgacgccgaatcggtcagcagttcgcccggagtccaaaagcgcagtcttccggtggacttcaacttcgagtcgatgaagcgggtcctggcggaaccgaccgaggccaacaagcgggaagcccgggagaagcaagcggccatcggacgcacgttccgcgagacggccttcgaagatttggtccgccggacggaaccgcagcatgacgtgctgcagaacaagctgaacgaaatcttcaactcgctgtcggccgaacggcagatcaactgcggcaaccagctgatgacggcggccggggcaaccgtggtggacggggccaacagcaagatgaaccagcaacggccaatctacgagaataacttcccggaattgttcttctattaggaggggggttgtggtgggagggcgatggatgaccttggtagaggaatattgttttaattttgttatcttttgtggtgtatttattgctgttagctagtcggggatgggctgggattgaaagcgtatataagatattagacgttggaaggagcattatcagacactccgataaatttcacacaataaagtattctatgcttaatatcttaaaattgttttttttttttgacggcattttgtctatactgaaacagacactgctcccttatgctctaccagcactttgaatggttcactgagaactttctttgccatatgaccatttttgcatttgtagctatatcgtgtagtcagtacgaaaaaacgtagtgctctgagaagccaatacaattttttttgttgttggtagcgataggggtagtactggcactcttaatctgccctaagctccttcccagcatttgcttttataagcctctattgcgttcatcacacagacgttcctaagcaatgttgctcaaatggtcactgtgtaccctagcagcaatcagcccttaccgtagttttgcagtctagtactttagactactatcaaactatgataaggcctgaaatgctactagagtggttaaagtgaagaacgaaatagttttattaaaaggtcctcattccccatttcatttcatcactcgctatcgtcacttttattttcgacactatcacgtatttcaccgattatcactcatcaactttcgtaatacacttcagatatactttccattatatcacttttcacatcacaccattttcat

SEQ ID NO: 202 - DNA, 47330 bp, Aedes aegypti
cacgcaaaaatgtgatttttgttgcgctgtgttattgatgttcattcttcgccgcaattacccaattattcaatggtttcaatttacttcaacatgtccaatttgtggtaatctacattcgaacaagcatcataaattgtacacaatgtatcgtgacaacataccgttgcaacactttgtatgcggaaaatgtcgttttaaagtccaggaaaagcatagaatggacataagcaattctgtggtttctccttcaaatgacgcttgggaaagtggcaacaatgtagttgcagcatcgaacgacaaaggaggtaaatcgatgtgatatcaatcagcaacagtaacagtatcagcttccttttcgcactatgtttccttctctatcgattccattagattcaaatgcacttttcgattgagtcctgtttcagtgcaaaattctacgaatttgaaccgtagaggatatgctatccacaacagtccatttttgtatgaggagagctggatgagaaagcggcctgtattggtggaatacattagaaatttgtaccgaaaactcaactgacagaaaaacttgtctgagtatagaagaaatttccagcaatggcaatctttctgtggttattactggaacggcaggtcagttcagttgagatgcggctgcgagctgacttttcactatgcaataagaaaaaaaaacaataggggaactgggggtaaaatgaacaccctaagcaattttcatgttttcttgcttatgaagctgtcagattatttttcaatagctcagaattgaagaaggatgttaatgcaatgtaacaagttggaatattgtgatggaaatataattttatcaacattattttaattttgaaaatgtctttccatagagtcaatgttccaaacatgtgggtaaaatgaacatgcaacgggggtaatatgaacatacacttgggggtaaaatgaacatacaatgggggtaatatgaacatatactgggggtaatatgaacaccattcaaattgaattgattctgatcatctggtacatgatcaatgcatatctcacaggcattctggaagctatggaacgtttagctgcgacccattggatggttgtcggtttctgtctttgtattttctccgttaaactatgtctttcgtggaaccgcctactgatgcaactgaaactcaattgcgaaatgcaaaaaagtttcttttgtttgcatatggcagtctaatcaatccaacgtcagataaagcacatagttagataaagcacaatcacagtttctaattaaaatttcatgtctccctctatctctcgttacagcaactattccgatcaaatcccggtctaacagctgccaattcggcggtcccgggtgcaccaaacggacaaccactgccacagtcagccctctcgctatcggcggcccaacaacagcaacagtttctagcgcaacacaatgcagcctatgcagcgcaacaggcgcaaccctacgtcatcaatccgggccaggacccgtccccttacatgggggccctcatcacggccggtgtacctcagtactacggagtggccgccccatggggagtgtaccctcccaccttgatcccccagcagcagtcacagccccggaggccattgacaccctcccagcaaggtgccgaaaatcaaccctaccaggttagtaccaaccaggacgaccagagaatctctgacaccccaagcacgtggttgtacccccgttccccttatccccgcagaaaatcctgaaatccctgccgggtcgactgtgttacactttggcaccaccggccgacgattatccatttattccaattaagcaatttcagtcaccttctattttgctgcctccacacattcgctccgagttcacgttcgccggaactctacagctctcctgtagggtggggcttatttccagaagcctttcgtaattaaaatttacaaagtgggaaatgatcatcggtcccaaaataacacactgtgaaaaaaaaaatgaatttttggtgaaggtctgaagagtcgcaaaggttgtaggtgcatttattgaattttagtgaactttttataattttggttttaacggctatcataaactaaacattaaatattctttgtatttggattaaatggacaaattgaaatgaaattagcaaaaaaagttacatgtcttctcggtgagagccgaactcacgactcccaatacgctagatagggcacgttacccatacgccacgagaggacccatgaacttagaagttaacctggattcaattacaaatcgataatcacgtgattctctttcgaaagtattagatgcctgtccaaacacaacgcttcctaatgtatatgcaatgtctaggcgagagcacattattaggtaccgtaaaatcgggtgtaattgatcagaagggtgaaattgatcatcgtataacacgattttatttattcgtaatggagcataaatatcaatgtaagctgcagtgaatgaacgttgtttgtcgtaactattgccaaattgtgtgttgtgaagttttttgcgttaaagaatgtttattactatgaaaataatgtaaaatttcaaaatcatgcgcggtgcagtattgataaacacctatgaatttctatttctaagcaaggatttgaacatggtataaacctgaaagtttgtgaggatgcttgagatatattcccaaaccagatttcatcaccaaaactcgtaccaattagctcatatggttgaaataattgaatttctgttagatatcattgaattccttaagaaattgcatacatttaggcgttttccgcgtaattcttgaaatttaactattcgttatttatataaatattgcattgttcagaatttgacaagcatatttggattcagggagctcaaatttatcatgtatagttgttttgaaaactaacaataatggcattgagaagtgatcaatttcaccccgaaatgagatcccctgattttttattttcgagatatttgttgacattaaaatgacatttgttagaaaatttcggtgcatgagtcgatgaggctcaccttcgtacttgttttcctgcattaagttgtttggctttgttaacattatagaaaacagactagaaaaaaagtgaaaaatgatcaatttcacccgaaattacggtattcaaaagaaaatatggggagttcattaaaatcgcgaaacctgtaaacctccaccaaaaattttaattttttgcaggagatgttgggactgataataactttaactttccttattttgactacgaaagttttctggaaataagccctaccctacggtccagttgttaaacgtcccatttccgctgcaaatgtccctcggacggacctaaatagaataatcgtatttgtgatatgcagacttgtccccgagcatgtaacccgaggcaatccattttccaacgctattttagtttacttataacttcagccccgaaaactctcccttacctcccttgtccaccaaaccgattctatcctgtctctgtcatgtcatatgcgcatttacatttttgtgatgttttcatttatgcataattgaacagtgcaatacctattgtcgaccccgcgcaatccccccaacttgtagtatacattattcaactactgtgtgtatgttgtacagcgagtggcagcagcagcaaaaacagaatagtttaatcccgttttcaccaacctcctttttcctcctgcaaagggtaaggcaccccgctctcagcagcagctcaattcggattgtgtgacatgtttctatgtcagagaattcgcgtaaggtgaggccaatgcattttgcgtgcatttttttctaatggaattcctatccaaatatggaggtggaactcaagaaatcgaggaaaatggagtgcaagatcagatccagtttaaattaaagcatttgaggcaaacggaaccaattttcatttttcctcaatgaactattagatagattactttttaaataagaatgatcattttcttctataaactatgaacagtccttgtataacgacaaaaatcttccatcgttggacttgaacgagttattggccattccacatgtgcgtgacactacgtttcacttatggactgctttatgacttttacttatgtggaaagagtgataggaggcgcaccaacatgatattgacccagaggaggagaactgcttggtatttattaaatattaaatactaattgccagggtaatttgattaaaacatcactcacttcgtcgcgtgccctcgtgtctataatttcataatacgttcgggaagatgtccttcgacgttttgcacttaaatgttcacctttgccgaggccgaatgttgtgcaccattctaagcaaacacagttaacctttacagtactgggtgtcgacatcgaaatctcaaaactctggtacttcgcaatcgttcgtcgatttcgatgatattttcagtaaaaatcacaaatgagttaaggtacagtgggggaagtgtatcagtggggtaagtggatcatttgtcaatataaagcataaatgcttgaatatgttgaatgttttcgcaccattgcttagttttaggttatattcttatgcccgcactgatactattgcaaaacttgtactacacgtacaccaacacaagcaaacctgttagctgcaaaaagtaattaatttcgaaattgttttccatcaatcaaaaatccattgtatctctgtcttaaatcgaattctattatttttttcgacacatggtgagcacttcagttctaattgaatgaatcacatggatttggacatggtacacttacccctactttttaatggggtggggtaagtggatcaagaattattatcatttattggcagactgcttacgagaattttattaagctttaatatccgcaaatgttgttttcctttattttcttccattcccagcttgaatttgtcaaattgatcatagaaaatttgaattaatccacctaaaagtttttttaacctttctggcatataaaaaattaaaagaataataatttcaaaatgtacacgaaacttttcgtgttttatctaagttgagttgtaaaagagcaaaatatactaattttccaattgaacgcttagtatcgtaccttatttgaccatagaaattgttctagacagatgatacacatatgtttataaataaaatagaagtatttcagtttgttattccaaagtaaaagtaactaatatttttcaactaagagtgtttttcgaaaatatcgttaggaataatccaacaatacttctgtataacttatgcgtataaatggatgaattttctccaaatttttctagagtcaatgttttttttttgttagatttagtatgaactaatatatacatactttctattatattttgattaaataaaggaactttttttaattttaaagtattataatgtaacattactagcactaataacaagaacgagagtaatatcatttttatcatacataatcacaccacatttgtttcgagaacagatttttttaattggtgatccacttaccccaccatggtggtacaagtggatcatttggtgcaaatttttaagtctctcatactcaatacataacaatcagaaaaataaaaataaatgatgatttgaagtataatagtccctcatttgttatccacagaaaaaagtttgaattacattattcacgttagttgtacataacaatgaagtcaatgattgatttttctgtatccacttaccccacggtaccttatatattttattaacgcattgaaactttcgaattcggcgatgatttgggacttaggtccaaaggtccaaggttgttggggtacctagtaccataaactttagtaccgcaatttcggatgaaatttacttttcacgattgttcatgcctgttttctattatgttgacaattccaaacaaattaattcaggaaaacaaatacaacggtgagctacattggctcatgtgccgtaattttctagcaaatttaattttttcagtactttccagtgacagttggtgacagtttcccttggctttcaggacctcgcaatctaagcaagctatctcctctctcactctgatgttgagcatcctcacaaactttccggttattttcatgttcaaatccttgtctagaactaaaagtttaactggttttacttcaaaactacaccgtacatgattttactggtattttacattattttcatacaaaaaaacatactttaacgcaaaaaaaaatcctaacaacatacaattggacaattggattacgacgaataattgggaagaaataaaattgcgtgacacgatgatcaatttcacccgaattcacggtaatttggtgattattttgttatttctgactgtatgtacttatgcgatatgtatacgatattaggtacacaattttcgtattagatcttattttaggtgcacaggtttctttcaacatatacaaatattataggcaggtttctcaatcatatatcttcatgggggatgttcagtaaaagtttgttgtacaaaagaagttttatatattcagataaattgtcctactattgtgaaacggtcaaatccgttaaggaaaaaactgttgagattatatctcaatcacgctacacttcagtcactgttctcggatttgccagtctaagagagaatattaaaaaatgtacaaattgtcatatattagagtgtcttttattttgaatattttttattgcttgtttttgctgacgcatttcatgtcaacttgaatagatgttgtcagcaccctctcagatatcaatgaaactttctagaaatgtagaccttcaataagtaaaccactttgcatacctagtttttccaaaatttatctggattatctttcgggaagcgctaaaattttttatggcattggctatggaaactcctacaaaaaagtgtcgtatggatgacttgtagataattgcctaaatttctgaataatttggcgatattgggcacaggacaaaaaatttaatgtcgcctaaaacgaaacatgccaaaatcgaacggttgattttattacaacttttatcaccataataatgaccacgagttaaatttacctgttttgaacatggtaagcctcaaaaatgctcactgaccagtgatccattgttttgtatatgtatttccgtattgccaaaagcgaaccgccctgaaaccgaacggtaaagttgccaaaatcgaacaggcactatactgaaaaaaaatctaatatgtaacacgcactgaaaaaaaaatattttcaaaatttaaagtcgtttcgataatttttttattttgctgtaattttgtctcatgatggttaattatgttaactataaacagtccatgcatcgcgagataggcacttttagggaaaacatgttttataacgaaaacattttcttgtcttaaaaatattttttgcgtatcattttcaagttacaattatatcattttcaagttacaattatatcagaattcaatgaagcttaataagcctatcaatttggtctgatcaattgactttaaactatcgagtattctatataaaaactgtagtatttgtagcttaaaattttgaaattttcgaaatttagaaaaaagattttctaagtttaaaattgattttaaaaaatgttcatggtttatttggattaatttgtttctcaagatattgtgtttactcttttcaaaactttttcttgtcttaacccttattttgcaagtgattttcaaacaaaaccaaacaagtgaaagtcacaatcatctcagaattcaataaagctcaataagcgagtaaattttgtctaatcagtgtactttaaatttcgagaattccctgttgatatgatcacatttaatctgaacactttttaatttgcaccacgctaatctgcacttcgttcagattaaaaatggttcaaaccagggacgaaaaaaatcatgctcactacactcaattcatcgacatttatgccgccatcaaagtaaccgcactaccaccaatatgattgtaccaatgaagatggcgcaaaaatagattggcaaaacaaacaacgatacccgtatgtcgttggtgtttttgattatcagaagcagaagagtgtcagttttagaaaattgattatcaatgaggttcatattaattaaaaaatatgctgctgtacgggtaatgaacgatccgatgcacgtaatcgattatattgacgcgtctttagtgtgcctcgtgtaaaaattacaatttcccgaagcggaatgttaaaaaagtcaagctagttagaatgaatatcattttttgtttccgattatcacaaagcggttgagtagcagcaggttaaaaggaaactgaattcttgcgcaagcgctttgccaatctttgttgtgttgtcaaggtgaggataaaaacaaataaaaatcaacgaagattctacccagatagtatcaatgtaggcgagggtagattgagtattttcgtccctggttcaaacgtcatttaccttatggaacggagtaaagcgaaatggaactttgtggaacaaaacgtaaaatcaaaacaaaacatccaaaagggtaaacagacacacatttttcagttgtacatagaactagaagttcaaatgaaaaatgaaccccgatggtttgcctgaggtaccgttcaaattagcgggggtgcacggtaataagggctcatgacgcgtttcttgccacgaagttgacaccactctcttagaattaaaaaaaaaatatatgagaccttatcgaaaatattatttattcatggttttgtctagtaccttctatgaattctgagataattgtgactgtcacttgtttaattttgtttgaaaataacacgcaaaaaatgagacaagaaaagtttttgttggaaatttgttttccttaaagtccccatctcgcgatgtgtggatggttgttagtaaacaattgcctatcttgagacaaaatttcattaaaataaaaaatggccttttgttttcaatcgacttgaaattttgaatatcttttgttttcagtgtaggacaaaaaaaaattattcagaaaattccataaaaaaacagcattcggttttacttcttaccgtaatttcgggtgaaattgatcattattctcggttgttcaggtatgttttctaggaatgttgtctatgccgaataactgaatgcaggaaaacaagtacgacagtgaacctcattggcttataaaaatcatgtctaatatgaaaaatcgtgagatcccgtttcggggttaaattaaacacttgtcaatgcaacttatttggagtccgtacgattatgctgtcttagttcttaacaataaaatatttatgaacattttcaataattaaacttgaagaataacgcgcaataattggtgctctattagtaagaaataaaatcgtgtgtcacggtgatcaaattcatcctaatggtcaatttaaccagcattttcggtatttaaagaaaccgaagaaataccattatgtataaattcggaagccaaaactgatatttctttcttaattcgaaaaataatgcataaataactacttatatgatttagtttataaaatcagagcttaatattttcaaaaactttaactcaatactgaagattgtttttttatggaagttgaaccgtttgaaattattgcgcttatactaattttctttttccttttacctacgtttaaaagagaattttagaaaaatctacaacaaatattcttagcaaaacgattattgatggcatcaacaaaaatgtaacaaacaaacagaaactgcaatacttaaagaaacattagtttctcaggcaaattaattagctgtccctaaggtgtgaaattcagtcagtttccctatgatgcttgataaatgtacaaaatttaaaaatctataataatatcaatgtgaaaaactgagcttgagcttgattggccgcccgtggttgctactccagtatcgccagatcagctgcactcacacaaggaaccaactggatgaatgttttgggattaattctttggaaacaatggcgcctgccacgtcagaatgcacaccaatgaggggaaggggaggaattgatgatgcattatactggctcccacagtagaccgtatataccactgcgtctatgccagttcatgcgggaaggtataggggtggtaaattttatggcagagaggcttgctgttagattagcagactgccaatgtatcccgcgtaaggaaaggcgtgctataatgaagaagaatggaagcatagggaagcggttgtatttttttccgctcgggttctagcaaatgctatgaactgtgataaatcaactatgacagattaagagcggaagatagaagcaagtgaaagatacaacaacaaagtacgagtaaaaaagacgggcctgggattgaacccatgacattctgcttaggaagcagaagcggaagccattagtccactaactccgtcaatatcaatgtgaaaactgaattacaaaaacatgtatcacgttcagcactataacagcatatcttcagtgagcaatttcccttcatctatttcgttaataacgaatgcttttggctgtaaccgaggcttccgaaattatcatcattatcagcatcaatggagccaacaattattttcttatattaataatacaaattaactggcacgtatctcacaaatgaatagggattgtggctttaaactaggcgaagagaaacactcgccgcagcaagttaacttcaacaaaacctcgaaaatgcatcagcaaaactttgtgccatctccccacagaaatagcacctcatcaacttgtttaacttttgattttcatcatcccgtgaattagcagccagacgagacgacgatacccacttcacactctcctcatccatcgcgcgccgccaggcagggagaaaaaatttccaaatcacatgctaattaaacgtcacctattcacagcagcaattttccgctcaaatgccgtaccttttttcgccattttcaaactgcactgctgctactggatttcccaatcgccccagcacgacgaccggttgttggccatttggtcgacaccggaccgaagcagcgaggtaacttttagcataaaattgttctcaattagccacttgttgacgcaccgtcgcactgtggggcagaaatctactttggttggccaaaatcgctgcagaagaaaatttgcgcgtaacgaaaagacctaactaacattaagatgctctctttgaatactttctcttcaatcaataagtgagccacatttttgtatggaacgctaaccaaggacattgtctttcgatccattgtgaaaaacttcccaaaagctttagtaatgcactgttataatcgaaagaggaatatctcatcgctaaataggtcctttcgaaaagttacgcgagaattctttagtaagcatccccagatcgctagagaggttatggtcaaccaaagtagcattctgacccacagtgcgtcgtaactcgcgtgcatcagtttgccaaattcaacaagttccgcgaacgcgtgtggccgggatgcccggtcggtacccggaacgataacccgataacgcacacaacagcccggtcacgggacgttgaccattttacaagcgagttgcctgcgaaaggagtacgtgggtagcaagcccaagctttccggttgtgaccctagaggtggtggaaacataggtaattaacaacttccattgcttccaaccactccagccctatctatggtgtctgttgtgtgtcgtcttgcaggaaggcagctagctacatacgatgtctacgttgataatacaggtcataacacatatgttccacacgaggtagggaaggttatgaccgtgacagtgcatctcttctctcaagccgtggcgttagctctctcttgtaagcatggtatgttgtcgggtagactgcttcatttatatggtcaaatccacaattttggtgaattgatgttgtttttcatcaaggattacttagaacttacatatcagaggttacttttgggatttctttgcaaatacctcccagattttttcgaatactttctgtagaatttacttcatacatatttccctgcagacatctatggaagaaggtgttggggcaaaatgtcgaatgccaaaacgttgaaagggtcaaaacatcgaaaggatcaaattctttctgatgagaatcattcttccaagaaattttctttcctggcctttttggaattcgacgcttcgtttttcaacgttatgtcaccgtagaatacgttaaaaaatcttaggagtaaactctggagtaactcatgaagctattttagagagatttttggttgctatattaaaaaaaatctgaacggcatttttgttggaaacattaagaaatccgtggaggcacttctgaagaaatctggtggattttttggagatgttataaacagcaatcctaaggaaatcggtggaaaaatcactgtataaattactggatgttttaggattttattgaaaaacatcttgaagaatcctaagaggaatttttgatggaatctatggtctaaagtaatttctgtgattatctttaggaaaaaagcgaaatcattggaagtcagtgaaaaataaccaagggaacacttgaaaaaaaaatcagagtaatatccgaaagaaactttggacaactacctcaattgatttctgattaaatcctcggagagggtcataaaacaacatggagtaataaaagcagtaatacttatctggaataatacacttctggaatggaattgctcattgaacacagctgagaagcagaatttgtcccagtaaggacgtaataccaagaagaagaagaaattattgccgaaaacgtgttaagatcaattttagctaacggaaaatgaaaattagatcgaaaaaaaaataacagtattagaaagttaactaaaagttgatttttgaaccagtccaaccaaccctccgaatttagttattatctttgcgagctgcccgaactcggttgtgttgtatacgatggatcagtacactgcaagtagctcagtgaccgcttaatgcacactttgcaaaccttccccatcatacgaaaacgtctggcgagccaccaggtgagttgggatggtttggtttcctcgaaggaacgccagacggtcggtggtggttttccactgcataccctttgtctagggaaaagctcagcaggtcactccacggcagctattatggtggtaattattgcaaaataatttcatccgctcaaatctccggtgaaatcttgctccgctcaagatgttcgcaatcgcatactcgacctctggcgcaggcataatgaagtggttgcggtagagaaattattagcttcggccagtgctctccaattttctcgcaccctatttccagaggaacaggttgaacgttccatttatcataatcagaatgtatggccccggtgggatgggatttgtctggtcatgctgatagctctatttgtgaacacattaaatggtctatttatggaaatatggcagtatttgatgagttatggttcgaaccattacaatatgcaatacaactcaattcacattcctatcaccacaatcatatatagaggcttatgacttatttgaatctgttttgctttttcccacacccaatagtaaattgcaattaataactccatttccgaaggtgtgtacgaactcaaacagagtgaattgaacattcaagtggacctaattataattttaataaacattaatcagtaatgtaaacgaacggtttaattgctttcgatttgctaaccgaccgcactgttgcaaccacagacagttcattttcgaactcgccgcaaaactatgttgtgtgtgtcctgtcctgttgtttgaatttttaatgacatcaaaatatgtttggtgcgaacgtattggtgcgtaaaaaatggatctagttttaattattaaatactattatttttttacaaattgaggagggtagtcagacatacagaaatcagatgtccggctctagaggcacaccgtttggaagataagatttttcagaagcaaagcggtcagactgatggtttgaaactctttgtttctcaatacgacgaacgtgcttcttttgggataaactttacaggaatatcacgccaggatctgaaagtatacacgatagcaaattgcttacaagtagtgttcttatgacatgtttgataaccttgctggagcaaaacaggataaaccccatctgctcctggagatttgcacatagcaaaagcgattctgtactagtagtcgaatccagagacttgtaactacatgaaaagacatttagttcatgcgtagatactatgtccacacaaccgaagaagtgtgtattgtataaacattctgaaactttttcttcaaaagtaggacgtagggctttcttgtaagtcttgcgacttgaacgactcttatttagttgcgtctgttccaactcctacaatgtttcctgagtctatccagtttagagttcaaccatcggcggtctgttaagactgtatgagggacagaccgcagaggacaagtttttgtttcaaaagtttccattccataacggcattatccaagtctcttggattttcaatagacgcaaagtatccatgaagtttgatcgcaaccaattgaatatagagctctcactttgttgaaaaaggattcctaaatcgcaaaatatgtattcaagtgttcaaaggagatgtagcgattattatttatctggtacattcgttttcgtcaactcgtggcggatgctgttcgagcaaagctttatttctaacatttcttctttagcggttcccagggtgtccatccatccaggaaatgcatgacaacccgagaactacaaacgaccgggaaaatacgggaactatccggggatttaaagaacacatcatttcaagctttatgggcaaaactagatttgttttccaggaagtgcacagctgatgctagttagaattccatttatattcatggcaaatttttaaagagatatttgctggaatcctaacagaaattgagcctgtatttgactggattttagaatgttctttctaagagactactaaaaaatagattgtttttaagatttttagaagattctagattcttgggtttattctacgtgtggcgtgaggtgagaattaccggtcttgtatagcgagataacaattctcgactcgaatgaagtgactagccgtgtaaatcaaatggaaagtcgctcgaatcgagtactgtcacctcgctatacgagaccatcaattctctcctcacggcacttgtacaataaacccaactgattcttggctagaaacattcacctaccccgggcaatctgtatgccaaaggggataaggctctgtggatctcatttatcggtttacttatcctaatgagtctgctggatgagcttctcagttgtggtggttcaggaaccgtctgactatgctgcaggttccatgaatcaccgctttttggatgctgtgtaggtccttcttcaattccagctcgtctagggaccttaggagagatttcgggacaattccggtcgctgagaggactaccggaactatgcggacgtcctctaggtgccacatctgcttcaactccttcgccaagtcgtggtacttcgctatcttgtttgagaacgttgattggacattgagtgtaactcgtttcatccttttgtcgtagactacaatgtcggggcagttggcacggatgagtacgtccgttatgatctcacgatcccagtacagctttaactattttccagaacactgtcaggtaggtacttttagtagggcacaaatcgatccaccaagttgtgcttaaggctcaagaatccatcattcagtcatcagcaatcatcaaaacttaaaaaccagtttttcgttcaaatttataacaatccttatgaaaatctatcatcgcatttcagatagtaagtgtaatgtaatgatagattttaatgagcattgcttgaattttgagcaaaaaaactggttttgaaaatttgcaaaacgaatgacgggctacttagccttaagggcaagctgttggtacacaatcttggcatcttcgttgtgacgatcgaggtaggctgatccagctagtactgaacagctggcaacgacatgctcgatagtttcccctactgaattgcacttcctacagcggtcctccacgtctttgtgcaatatgtagtgccaatagtttttcgtcgcaattacccggtcctggatggctaccatgaaaccttctgtttctgagaagaggtcaccccgcaccagccacgtgtttgacgccaccttatcgatgtgctcgacctccagttgatgggggtgcgttccatgcaactccttctgcttccacgatgcgatcatctcatcgacggttttgatgtcgcagttcagctggtaatcctcctgcgccagatgcagggcgctgaagccgtggtcagcttcgcatacagtgcggtaaatttcgtggcggttctggctttctacgaaatatgcccacagctgctggatctgggagacacatagtgcctggatattggtgacgcctcttcctcctgctacacgtggcagggtgactctctcaatggacgattttgggtggcgcattcggtgcttggttaacgctactcgtactgctcgttctatcgcctccaagtcattcttggtctactttaccaccccgaaactatacgtcaacagggacacagcaaacgtgttgatcgccttcaccttgttgccggcagacagaaagctcttcaaaatacagttgacacgagacaagaacttttcctgcagttccttcttgatcatcgtgttgcgaatacctctatgttgcaggaatccgaggtatttatacatttcgccgtcaaccatattccgaatctcctcctgctcgttgacgcggaaacagctggcatccataacttgaccccgacgtagatgaattgaccggcatttgtcaataccaaactccatccggatgtcgttactgaatgtcgtaactgtcgaaaaatccccctcctgatgctgagagtcctagaccgtaacacaactgtaccgtcggtaatgtgtagggatgtgctccacatccccatcgcgtgttgcatcagcgtgatgacgttctcgtctaacttatacaactgcagtaccttgagaagatacgagtgaggtactgactcatatgcctttttgtagtcgatgtacgccatactcagattcctttgcttttgggtagcttgccctacaatgactgcatctacgatggcttgatctttgcggccttgcatgtttctgcgacacgctttctgttcctcgctcatcacgttgttggcgtcgcaatgggcttgcaccctcctcgctattaccgacgatagcactttatagatacttgaaaggcacgttattggtctgtacttcgctgggtcagctgtgagttggtcctttggcagaagaaatgtgacacccctggtgatgaattccggtagctgcgtggggtctaccgtagtaccgtattgaaacatttcgccattcgcccattgatcgttatgagttttttataccaaaaattgtgcacaaaatcaagtcctggtgcagccgtccgtttatgttgaacattttattccttccgcttcgaacattctccataacgtcgcactcgtttcgcaagagcactcaactgctgtactgggtgtcgaggatctcagtaatgtcgacttctctgagatctcggagctgtgcgggcctaacaatttcagcaacatgacgaactagcctcgttgatcgattctcctgcttgtactcgctcgatcttgtctcctcctctcctatttccctctgcacttccagcttgatgtactccacttctgcagcggtgagcaagtcaacctggcgcgcaaagcaagggaatcgctcgttgaacatctccagcatccctgatctgccagacatgtccgtctccatccttgtgcagatatagtagcagcgaatcacatacatattcatcttccttgtccacatgatccgctgccgtcggccgcctgccaacgtgagtgactgacgtctatcagccacagcaacatcggtaggtgcagcatggtcttggtgatttctgttgctgccgtttctgtttcgcgttcgcggtacggtctgtgcctgttgactggaaggccgctcttgcacattatcttcttcccgccgctggccgctcgctgtttcccccgtcccaggaccagcttcagtaggggctccctcctcgggcgatcgcattcttctattcctcattgagcgtgtctccattgctccactgggtttgctttcatttacggaagctttgggttctgcattggcatttcctccaattacagtgcttaatagcttggttcaagcgccgctgctcgccgagggtggttttacatggacgcccaggatattttacctcaaggagttatgttgcctgagctcccaccttatttagttccaacgtcccacgaatcaatttatgtgtctctagtcgatttgaggtttgtgaatctgatgcttttcagaaatgttccagcacgtcacaatttttagcaacaaaatgtttggccaaaaataaggcttaaatcataacaaatcttattaagaatttccaaccttgccttgtttgcttcagatggatggcaacaatgaaacctggtgtgaaaaagtacaaaaaagcagcaataaattgttctctgatattgcttaaattttaaaagttatttcgtatgagttaattattggttaaaatttgaactaaatttctccaaaaaaagacttataatgtttcaaattcttaaaaaattacagaaaaatagttgactaattttcaaaaaattataacatttttttgtagtcaacatttgattctgcttttatttttagtttaatcacgtacccgaatagcctagtgatagttaaagctgatacctaaaaacttactgacttaacgattgatctattctgtcaaaaaaaaaataaataaataaacagaaagactaatttggaaaatattccaaatataagttagattcatgattaaaaatctacaacctttcgtcgcttccgcttctgctcctatcaaaacaaacaccctattcacgcttcgctgtgcgttacgtgttcttatctgtttttccaagaaaacattcagtcaaacgttcagtcaattatgcatttccatcaaataaaagtgcgcgaatattttgctttctggaatcgcatgccaactgcaggcagcggcacagccaattatggcacagaatgttgcacttaaccatatacgaaaaccataacctttcctctctccaagtacaattgtctacattttaattgctagaaacctatcgaccatcatatgctcgaagcaaatcagtttcgctagcggacagcaaacccccctgccactaggcatacgcgattattattaatatattgcacctccacgttcgtttctccgttcagtatttgcttacggctcaagtgcttcttgcactacactctcactttgggttgcatggttgtaatattttttgcgcgaagcgtgccaactgttggcacttgcgcgcctcactctaattaaatgctgtaacgtgccccagccccagggccctgttgatgcccggcgattcaagtaacgagtaagaaattatttctcgttctattttcccggtaatgagccgcaacgccttgccacttggctgccgccaggcaaatcctacgcaccattgagaatcgttctggtgggaccgcggaacggtatggttccgtttgctgttaaaaacaggaaaatacttatatgccctaggaaaaggataaccatcagtatagcttatccaaaagcagacaatgacataatttgaaataagcaagaactcggtatgaatttacaatttcaagcttcgatgtatcacttaagaatatatgtctgcgtaaaaaatcgctaaaacagcaatgaaaatggaaatcagcatttaaccctctaatatcaaactccgcctttaaaggtattattcaaacgttgtagtgatataatccaccaagcttgcaacaaagggctttgttagaccaattggatcaataagtagaccatttgagtattctaatgagctacaaaatcattccaataactactttacagtttaaactgaatcaattttcgacgaattcaacataaacgaattcgtcgaaaatttatggtgctctacaacaccatgcgcttcaaatggttaataaaatacgttatatttgccttcttcaaatgcctgtttatttggctgccgtttaaaatgttgtctgctccattgggcgataggccctcctcttcgactgttacgccttgtttgaaaatcatgttcatcttatccgatgcagctgagatcaggtgttttcccgttcctatcctttccaattaaaaaaagctccctgaattttggttgtataataaactgatgtaacaattatggtaacaatgataccttaagggaccgacggaataagtcggaacaagtaccagaggcaagagggatcacctaaaatgctattcagtgaaatatttataaataaagaatctttatgttattttaagatttgaataacaaaatttaaatgttgtaaagctgaaattaacactcgcattcgagtgggacccatttgcctcgatgtaccatatgtttgatactactactctagctctaggataagaactgtacataatgtcaattatttcctaatgtatgtttgtatattattttctttctctttttcttcttattccgaaaaaaaaaacaaactcatatcacattcacatcaaaacacgtaaccatccccccaaaaaaccaatgttaccaatcaatcaaccaaaccatgtaaaaattctatcacaatcgcgccatcggctgccgttttggggtgtcgtccatcaggtgatatcggccttctacgatcagagcggttcgctggtgatgggacctcgcaccggaacgccgatgcggctggtcagtccggcacccccggtgctggttccgcctagtgcggccggtccacgcgctccgcaagccccgccagcgatctacccgccgcagaccgcccaacagagcatgtactccgccgccgctgccgcacagaatggatccaacattggaggtaacgatgaattagaaccctaattatgatcccccaccccctcattacagcagttaatttgtatagttttgtctcctacgaggatgtctgtgaactcgatgaccaatctcgttcggtgattgaactgagaagaccgataacacacccacgcaatgtgaatacaattttgatgttgatgcatacataataattgataataatggactcattgcactgcaaataatgtataaaaatgtgtattttcaaatttgtgtgaaattttgtatttattgtgaataaacttaatttaacccatcaacatatagaacactaaatgagtgctgcgataatcggtgaagcgattttatacttgtgactagtagtgcaaatatctcattgactacagagcaagaacattaaatgacttagtctaaatgtacacattacggaagaatattcttgggattttatggattaatatttgtagaatatatttcctcagaaaagaataacgtacacaccatgtaaatgctcatacacggaaaaaaaccgttgccggattcatgaacaaaaatttttatgttttatgatttcatgattacaagttatgaaagcatgtatatttttcaagaatttgtgtgctccaggcgttacacaaatctatctgtcacttttttcatcttagtcaaagcgtcttttgcgttcggtgaagtttacgagcgaaataaaaaaacccttttttgtttgtgtgaaaaggattccaaattgtttcacaacccaaataatctatcggtgctattggatgttccaaaatttacttgcatgctttcatcattaagcgaatgtgttgcttgacaagcttgtcgcagattataactgttcggatatgatacgttccccaacgttttacaatagaacggatcacacaagcaggatgctccaattccactttctacctccgtagagtgaagaagtgtcccatcaccaaacaatcgttcagcatttttttaaattgatgtttgaaagaacattttgcgtacaaacctgagcactggatgttcgcgttcctgctagatatgtggcattcttggtggaactcgttacggttgacatttttaaaatgtttttcacgttttattcttcttcagtaacgcgggtaatacccggtggcctaaagactaatccgacacgatttttttccgaaactactgacgcaaaggccgaaacgattacaaccttcattcatgtttacctataacaaatataaactggaacctatatgacgtattatgattgttttcatgaactgagttcatgattccatgatcctgcttaatgacttcatgactcaatttgtcacttttcagcataaaaataggaatcataagtgacaggtatctaaatttatgaatagtgattacgtttttatgaactgtattcatgattttagatcctgcatcatgatttcatgaccaaaattgccacttttcatatcaaaaataagaaccatatatgataggtaacgaaatccatgaatcgtccttatgttatcatggatttcattcatggttccagcatacatgcttcatgatctcatgatttaaattgacacttttaaacgctaaaaaaaataaaaagtaacgcattgctgacgttacggtaaaatgattcatgatttcatgacttttagtcatggtgtattctcataatttaaaaatccacattctcccccgaaatcatggctctcacgccttttgatttgaatagcgaaacaaggtgattgaaaaaaaaatgtctggaactggggtacatcaaggtattattcttgttgtgaaatatgtttattttgcgtatttgcaagttaatcttatcacgtctcttttgtgattatattcagctttttctgtatactattagaagctggaactattagaaacagaaaatcttcctctttttgatagcgatgttaaattatatggagaaagtaatatttgtctcaaagcatgagaaacacacaaaatcgagctaatctggaccaacacaaaatttgtgtaattttttcatacccacaaaaaaaatcattcctgtgatgatttcttgttccttttgttataaattatacaatatttgtgcaatttgcacatgctcgaaaaatctaaatatgctgatttcttcgtaggggaagtgatgttaaaatgaacaccttaagaatatcatctagtttctaatgtaaaaaaaacaatgaatttgtatatttctttcgcacaacatcaaaaatagagacgttgtccaacgcagcgacacgcatttagactaaaatagttaatttttcacagttgttggtggtgatatgagcagcataaaatatatgtgagcaaaacaaacatttctgaaaatttcaatcatatttggttgtcatcgaattgaaaaaagttctaaaggtgtctgatttgacctcattgaaaaaaacctcaactcatgcaagcttaaaattacataagatctaatgtttgaacgtggatttttaaaatcatggtcttcgttgatgttttctcttcaattgacctccgtatcaatttgaacatttgtaacttatgctctaaatcgttcttgagtgataaatattgaagtttgtttttcatgcgcgataaactcgttgttcattttaccacctttttttcatttttaacccttttccctactgagaagactcgtggatttctgtgtctcaaaatgtagaagaaagaagtgaaaatctgtaaagaagaagtttaaaggatgtttaaaaattacacaaatcatgtgtttgccaagaagaaccagattatgtgtgaatcgtactcaattctttgtaattttgttttagtgtgaaggaagctgctctaaaaaaacagttgtgatctagaatgcgcccatttcaattttttttaatttttttattacacattattttgtgagtttttattctacttgaaaggcttcaatttctagtagaataaaaactacatcgagaaattcatgaaaagttggaaaaccctacatctactttactgctcataaacgcataattgtcccaagtgaatagaaaatacagcaaacatgtatttatagacttatatagttattgatcggagtcagcaaaaatgaactaagaatcaaatagaagatcgggtcgataggggcagtttgggctacctgaggaaaacgttttgaaaatcatagaaacgcgatgtaatttaatcgtcccataaagttgagttgtagtttgaagtgcctccttctgtgacatggtcatattttgttaagaaaaaagttacgtagaatatttgccatgtgatagttgagtcggcagtggccagtcaaggctttgactaaaagaccgcgattctgctttgacagatttgttaaatactttgcaacctttgcggatggctcagtaatgtaaaattttgtttgacgagatgattccaaattattccaatattgcttgtgcctagttgtcgcccaagcactttgaaattggaatagctggtttagagccaatgaagccatgcgatgcttcattgcgagctaaatcattagccaattgattcccagcgatgggagaatggccaggtacccatacaaggctttacagagttgactgaattcagttcctcaatttgagttcgacatgcgataacaagtctagaccttgagccgaagcaagagcttttatagcagcctgactgtcggacttacttctttacaaatagccagactcttcctgtgaagggagttgtgtggagcaaatttcctataaggaaagtgacaagcaattgtgagatcactcgaagcaagtataattgtgtccccattcacaacacatccaaacatccaaatcactaggatttccaatgaacgagagaatccaagaaatttggtcacaaccaattcccagtttgtggagcataaagaatgcaaaatctgcgaatttacaatcaaattttcaaagaagatgtagcgatgttcagataatgactcatcatctgccaattcacaatcacatgccaattcctcaactcgtgacttattctgttcgagcagagcattgtgtctaacatttcttctctagcagataccatgaaggttgggcggttgccaataataagtaatccaagatctgtctacttaagtattccatcagactggagcctctcaaattgatatctgagcagccccagatgatgtgatgagcattggcatcaatgcccacaatcagcagaaagcattttgttacgcagtgtacgataactcgtttgagttcatctgttggggatggttcatcatgtggtaaatataccgaacaatagacgtattttctattgacatcaccaacagaaacatctattgtgacagcacatgcatatctggtaggtaactcagaaatgagtgtatccgttagtggttaggtttcatttagaccccctaaccattcattcctaggcacggtacgcatcacaccataaagtaggggtcacctgtgaggtggaacaggcagtccgtagtgttaattcttagccaattgaaactatcgctaacgacactacgtggctatcaaggttggtcgggaaaaggagattaatattgatggttgactcctgacgtaccccagcagttttctgaagttttcgagagtttttacaaggtttgagtggtacaagaaacataaaaacgcttgcaccaattcacttttggcacttttaccaattcaattttacagcaatccctgtccttcccaagaatcaatcttgtccaaaattctgtgagaattgtgctaacttcagaatttagcccagaactttttagaatatcctaccatggactctgtaaaaatgaaacccagcatttcataataatctttcacataataatgtaagatatctgctaagggttttgccagaacatcacctagtattatttgaaaatcctgtccataattctgtgacaatagtcgtaaagtgccgtaattcagcgcagctctgaccctgattccgcgcatttttgaaaattgctttaaaatttaaatgtgttgttaatagaaatgtattgcgtaattgtacggataatatatacggatagcggtatgtacaaattttgtaatttaattcaaattcgtaaaattttggaccgaatgagcgaaattaggtaacccaggttacattggtagctgaataacatttattcagttgaaaagagatagtatgaacaatattttaattgaacaagctgttgttcagctactaataatgttacttaggaatgcgctgaactagggcactttatggtctgtacctggaaaataacaatcctgtgcaatattgcaggcgaattgtgtctagtattccgtcagaaggtcgcttacaattgttttagaaatcctacaatagagtctgtgtcaatgctgtccaggatgttttgagaattgagaatccttctcgggattctgtccgaatgttacctaggaatctgaacattttgtgagcatccctagaatggctaattcatcttttcctaacaattgaaaagattcagttttgtagggttagagaaagtcatactggttcttgtattctaatcaaattaaataaacatgtttttctattatacactcaaggcgattatcttaagttggattcatgtaaatcaaacaccaaaggagtagatttagaatgtagctattgagcaacacgtgttcaaaaaaaaaattcaattaaattttcttcgtatatcgtgtggcaggtacgattatactctatgcccagggaagtcaaggaaatttccattaagaaaagatcctggaccgaccgggaatcgaacccagacaccttcagcatggctttgctttgtagccgtggactctaaccactcggctaaggaaggccgatttgtaaatttataagaataaaattacaagataatgcagaaatcagctaacttgaaaaaattaaaattaaaagttgaaaaaataatttgcaactgacagaacagtttatgggccaaataaaactaaagctttgaaacttcatgggtcactcaaaatgaagacgcaggccgctcgttggacggctatggtataaatgtttccacgtatttaaaaactgaagacaatctcagccatttgatacggaacacttcagttactgcaggaactactttgtgtttggcattaataacagtcttaaaatataaaccaagcaatttatgatgccagttaatgtgtcaccatttccattgcttgaaactgactccatgagagtatgcatcgagcgcaatgatcggtgtaacatgataccgttgcaaatagcataccttcatacaagcaagcatccaataatcttgatttctgcattctttccattcgttagttacacttcgagcgtatctaagatgctccagtttcttcgattcatattcatattcagtagtcagactaacacaacacacatgaacacgaacccaagcccgggaagagctctagcgagcgacgcatgtgtacatacaacaaaaatcgagatgctatctactcgaagtaagaaaaaactgctgtcaacctccttcgtgcttcgtttgctccaattgtatccagtatagaagtgtagaacgcatacgagagaaagaaagggagcaaccttacccgtacgtaggaaaccggtaatcaagtaattgatgcccttattaccttctaatcgaactatgaaaggacgggtgcagcgtgcagcagacgaatcaaggtgacgttgatttctcctcgcgtcagagagatgcacactaattagggtgggtgaaattataaacgtattataacgtttgaaaatctcatctcccatagcttctttacaattctagtgatgaaaatggagcgatattttcatccgtctcggtgaagtttcaaaggttctcaaaaacgttgaaggctcgtatgaaccagcgtgtgaccaatcgattaagttttcagcacgaactgctatctggttctctagatttgtggtcttgaaaatttgaggtttcgcttcgatgcatattcaccttaacgtaaaactatcataatcatgttgatgctagtatgaattatcgaacctcatgactatgatgaagaaagttcctaaagaaataaattcatcttgggctaattttgcaaatgtttgactataatctaacaaaaaacgaaataataacaaacaaattgatatttatctcttgtttcatctgtcgaatttagttgctttttttaataacttgctttattatggtttgaacaatgaatttttctatttgagatgataaatttgtactaacattatagcactaacgtggtaggaacatttttcaaaatttctccttagtaatttctatataaacctattttgtctctgagccacattaaatcattaatttttagaataaaaattgcagtaaagatatgggagatgggattttcgatttttttttttcaatataaaccaccctaatgcacacattgaacatgaatagatgcatggtggccatccgactgggtacgtatccattcccttgttggttggagtgggacataaatgcagaaatccggttgtctgctttgtgcagtgcaccgtcgagcgaagcatatgactataattgagatgaaagtcagtttatcagcccagctcagacacaaacacacaaattgcagatgattgataacagcgctatctaatttatgagacagtgagtaattcaatatggtcgtcgcgtcgtccctatcggggtataacgctcacctgtacttgtttctgcggaacaagaactgaaaagaaagctgtctggctttatgcgagacacaatgtttagctatgatagaaaataattagaaatcgcgaagggtagacctatttttttgtaacaacttgtttcatttttcaaataaaacaaactatgaactgaaccttggatgaagtttttaccctttaaaggaaatcagtgtgggtgtccattaattttaattgtcttcatgaaaacggcaccgttgcaaattttctgttttccattttctcctttatgcaattgcaatacataatcgccaaagcagtcactcgattgtcttagcaggttaccttttctgaaaccactgtatcgtaaagctacaattgcacgtcatttctgcacccacaaactgtgaaatgaagcaattcaatagcaaaccacctacccaccgctatttgttaacgctgtcgtttttccaaatcaattagtcaagcttttgcatccgatcgatgtcccgcgtaaccggcgccctaactgtagcagcttttccaatgtttcgaagactgtatagagttatgtaaaatcggttcacagtaagagacacagttagaaatcgaccaaccgtgaaaattgatttatatggtttattggtcctgtgttttgctgcgaaacaatattcactccaactttacgcaacacttcttctaatccatctactttcttcatcccaaaaccttttgcaggtctggcgctaagcacatcgtccctgactgcacgtagggactccttcgaccgtaacacatcggccttcagtccttcgttggactactcttcggcgtcgactaatgccgtcgtgaacaatgctgcggctgcggccgtcgcccggaagtggcctgtcggggccggcagttacggcggattaagcgcgattaccgcgtcggccagtccacttggtgcctcgatcacgcctcctccagtttccggactgggagctctggtcacaagccgtgcgccaggtgctgaaaccaagtaccgacaaatcaatcagctggcgccaggtatttcggcgaatgccatgttcggatccagtaactccctcttctccaaactatccggatcggcagtgagacccacagcgacagcaactgccgtagttgcagccgttgccggaggtgcccctggattggatcgtccacctggacggtcgagactgctggaagacttccgaaaccaacgctatccaaatctccagctgcgtgatcttaccaatcatatcgtagaattctcacaagatcagcacggttcgcggttcattcagcaaaaactcgagcgagcgacagctgccgagaagcagttggtgttcaacgaaattctcggagcggcatatagcttaatgactgatgtcttcggtaactatgtcattcaaaagttcttcgagtatggatcaccggaacagaagcaagcccttgctcagcaagtcaagggacacgtactgccgctcgccctacagatgtacggctgccgggtcatccagaaggccttggagagcattccgaccgaacagcagcaggaaatcgttcgggaactggacggccatgtgttgaagtgcgtcaaggatcagaacggaaaccacgtggtgcaaaagtgcatcgaatgcgtcgaaccgacggcactgcagttcatcatcgatgcattccgcaatcaggtgtactcgctgagcacccacccgtacgggtgccgagtcattcaacggatactggaacactgcacgccggagcagacttcgccgattctggccgagctccatgctaataccgagcagttgatccaggaccagtacggcaactacgtcatccagcatgtattgggtatgtgtgacaactcggggatctgctgggaagttcaggaaataatgtttgctttctttttttattctgatccacagagcatggtaaaccggaggacaaatcggtgctgattgccgctgtgcggggaaaggttctgattctgtcgcagcacaagttcgcttccaatgtggtggaaaagtgcgtcacgcatgcaacgagagccgagcgtgcactgctgatcgaagaagtgtgctccttcaatgatgcgtaagtatttggggtttgctctcagggattcaaggttgatttgtgagaagttttagatttcaaaataagtttctcaaagatcattcgagaatcaaccacagcataaatttggaacttttacgattgtgaacaagacaacagtcactttgcatttcacatattctatttcttcttcatattcttctgttttttttttcttctgattcagtctaattctcagcttagtgtcctatgagcacttccacagttcctaattagttttgttactgctagatcgtacatgatctgctcaactactgactcccaaaacccccccttggttgcgccactggatgatggaataccatttttacgagtcttatacactcgttgtcaaaatctaaatcattggtgaacttttatttgggcttaaatttcgtaattggaagattgaaaatatttttgtcgatgaaaatgtccgattcattttgtatgtgacagtctcagctgaaaaataaagttttcttgaatttgatatgaagaacaactcttaagcttgcaaaaatcaaattttccccaatagaaaattttgcaactttcagggtgtgaaagttttagacaaattcgctcagttcattcatttcatttatttagttaacatctacacagataacactgaatcaacaatttcacgccacaatactcgattcgtggccgcatctctccatcctcggttctgccccacgctcgccaaatcgatactcacttgatccgcccacctagctcgctgcgctccacgccttcttgtaccaaccggatccgaagcgaacaccatctttgcagggttgctgtccggcattcttgcaacatgccctgcccatcgtatccttccagctttggccaccttctggatactgggttcgccgtagagttgggcgagctcgtggttcatccttcgccgccacacacctattggaggggtaaattagcagagagaacagtaaaacacgtctttacagatcgaggcaaaacacttgaatgagctttattcatttccttctttcattcacttttgagcttcattcagtcagctccttttacactcgattggcgcgcgatgctgaatgacgcagggctgccatcactcctcctcatcgcgcagagatcgcaatccaatcctctcgcgtatgtcctccaattttaccctgttcagcggtttcgtaaaaatgtccgccaacatatccgccgatgggcaataagttacatttacgttgtcgttttcagccaaatccttcacgaagtggtatttggtgtccacgtgcttcgaacgcttcagtcctgcattctgctccaacatcttgatgcaactttggttgtcttcgaagatctgtactggttcctgtacaggctccccgaagtccttcaatagttttttcagccaaagcagctcccgacaactttcagctaacgaaatgtactccgcttccgtcgatgaaagtgccacacacgattgctttctggcacaccatgaaatcgggccaccacccagttgaaacaggtagcccgaattcgattttcggtccttcacatttccggcccagtctgcgtccgcgtatcctcgaagttcttgtctgtttacagccaattccaacttcaaatcactcgtagacttcaggtagcgcagaacccgttttgcttccgtccaatccgcattcgttggcttgcttacctgccttccaagaatggatgtactaatagcgatgtcgggccgggtatttactgatagatacagcaaaccaccgacgaggctctgaaacttctcattgttcggtagactctccagctcctccttttgctgtaggtatccgacgtccataggaatccgtgatcccttagcatccgcaagtccgaactgtgcaaccaacttgtcgatataagccttttggtccaagcagtaggcgttgttcttccgcgtcactcttattcccaaaaaatgtttcacttcaccaagtgttgtaatctggaactcgctagctaaagccttcacaactccttcgtagtcttcatcacgtgatgtagcgattagcatatcatccacatacaccaggatatacactgtgccgccgctcgtcttccgcacatataagcacgggtcagcatccgcctgccggaatcccagtcgcttcataacatcattcagcttttggttccaaaccctggctgattgcttcaaaccatataggctcttacgcaaacgacacacctgtcctttttccactcgtaatccgggtggtacccgcatataaatggtctccttgagatcgcctttcaaatatgcagttttcacgtcaacgtgcctgacctgcatctcatctcgtccagcgatggtcagcagtgtacgaagcgtcacttgcttcgcgactggggcgaatacctcgtcgtagtccaggccatatcgttgcgtgaaaccttgcgctactaatctcgctttatatcgtattagtttaccttgctcatcctgcttcttcttatagatccagcggcatccgatggtcttgcttcctggcggcaacgacgtcaagtcccaggccttgcactcccgcaatgacttcagctcgtcgttcatggcggccttccaatggccgttctcaggatcactcactgcctcttggtagcttcggggttcacactgctgactccgagccagtttaccatccgccacgtaacgttcaggtggaatacctttcgttggccttccagaccgacgaggtgtaacggcgaattgctcctcctgcaaatgcctctggatcgaaactagttcgtcgtcctgtcgagagacaacactgccattggcatcttcatatacactccgatctgctggattttcaaaaccaatatccaaattgtcgcaagattcttcttcaaaaccacggaattcttcctcatcgtcacttcgctgacttcgctcatcttcggaatcttcatcggactcgtccgactcttcatgctccatgttgctggacggtttcaccggaggcaccacgaaaatttcgtcatcgactgcatccggaatctctcgatcacttgacggcaagaaacgagcatcacgactgaaaacgatttcgtttgtcttcaagtcgatgaaacgccacgctttatgctgctgggagtacccaacaaacgtcaattttgtcgccttcgattgcagcttcgtccgcttttccttcgggatgtgcacataagcttccgaaccaaaaatctggatcatgctcatgtccggcttcgtaccgtgccaaatctcgtagggcgtctgctgcaccggtttcgttggcaacatattctgcagatggttggccgtgttaaccgcctcggcccaataacgataatgcaacccagaatcgatgatcatacaccgtgccatctctaccagcgaacgatttttgcgctccgcaactccgttctgctgtggcgtgtatgctgtcgtaaattgctgctgaattccttcctgcttgagaaacttgaccaactctgcgctgcggtactctcctccttgatccgatctgatgatcttcgggggtctaccaaactgcgttttcatcaaacgtacgaaatctcggataacgtccacggtatccgacttcttcctaagaatgtatagagtggtaaagcggctgtagtcgtcgatcagcgaaagaaaataccgacgacctccaggtgtggccgttttcatcggcccacacaagtcactgtggatcaaatccaacaccgctttcgacttacgcctcactttcttaggaaatggtcgccttgccatctttccctccaaacagggttcacaagaataacgaacagagcagtgacgtaccttgatgcctgttgctaaagctttccgctccagatccaggatagcttgagtatcacgatgtcccagcttcctgtgccactcgtgtatgcagttcttcgtatgacactgatccgaaactgcactagcacgttcaaccatttgaagatggaacagacccttgcttgacggcgcaatagcagcaatcttatcaccgttcgcaatcctacatccgttcttgtcgaagattacgctcgctcctttctgaacgagcctgtcaacggacacgagattcatgtcgagatcaggaacgaatagcacttcactcaacaaaattcgcgtttctgcgccaccacctccgatgcaaaaaatctggcacaatccgacgcctttcaccgctgcgtgtttaccgtctgcaaccgtaaccgatttcggagtgtccatccgcggttcattgaacgacacgaaaaacttccgatttgcgcacatatgcgaactcgcaccggaatcgacgatccagtctttcgccgcgcactcactggcaacaaacgcactatttctcggttctacgttcacatcggaattgacgacacaaccattcgtcacacactctctggcaagaaaagtaaattcttccgatcgcgacgtcgcaagcttcgccttcgcgagctttttcgacacttttctcacttcgctgtgcctgctcactgctgagctactgtcaccttcttctttcttctgcctcagccacaagctgcagtttgctttcttatgaccgggcttctcgcagaaaaaacacactgagtttttcttcttgtcttccgctttgagaacaaccgaatccactaccgccggatcacgacgcttgtgcacttcgttaatgatcttccctttcacaagatgcatcgttagctcatcatcggctcggttctctagcgtcgtcgtcaaggcatcgaacgaactaggcaaacttcgaaacactaaaaccacctggagatcttcgtctagttttgttccagcattagccagcttctcgaacaaatcctcaaactccatcaggtgttcttcgatgttgtccccgtcgtggtactccatgtcgcagattcgcttgagcaaatgcactttggtcgtaagcgtcttcttctggtgctgcttttccaaattgtcccacactgctttcgcggaattcgtattccggatatgcccgtgttgactttttgtcagcaataaaccgatcgtcgcgcgcgctctctggtctccctcgtcccaggcagccagttccgcgacgttcgaacccgaagcagccacttccggcttcactcccggcgagacatacttccaaagtccttctctcactaacaaaaactcgacttccaatttccacgaatcgtaattatcgttcgttaacttcgcgataccaattttctccatttttgttgaatttaacacttccggaaaaattccaacaaacgcgccacgacttgtctgaacgtgttcactttgcacaaaaacaaaatggctacttcacaggcccataacctattggaggggtaaattagcagagagaacagtaaaacacgtctttacagatcgaggcaaaacacttgaatgagctttattcatttccttctttcattcacttttgagcttcattcagtcagctccttttacactcgattggcgcgcgatgctgaatgacgcagggctgccatcaacaccgttctcctgcacaccgccgaagatcgtcctaagcacacgacgttcgaagactccaagtgcttgcagatcctcctcgagcatcgtccacgtttcatgcccgtagaggactaccggccttatgagcgttttgtacatggtacatttggtgcgggcgtgaatcttttttgaccgcagcttcttctggaggccatagtaggcccgacttccactgatgatgcgcctccgtatttcacggctaacgttattgtcagccgtcagcaaggatccaaggtagacgaactcgtcgaccacctcgaacgtatccccgtctatcgtaacactgctacctaggcgagccctgtcgcgctcggccccaccagctagcatgtactttgtcttggccgcattcaccaccagtccaacttttgctgcctcgcgtttcaggcgggtgtacaggtctgccaccttttcaaatgttcggccgacgatgtccatatcatccgcgaagcaaacaaattgactggatctcgtaaaaatcgtaccccggctgttaagcccggctctccgcataacaccttctagcgcaatattgaacaacaggcacgaaagtccatcaccttgtcgtagtccccggtgggatccaaacgaactggagtgtttgcctgaaaccttcacacaattttgcacaccttccatcgtcgctcttatcagtctcgtgagcttcccgggaaagctgttctcgtccatgattttccatagctctacgcggtcgatactgtcgtatgccgccttgaaatcgatgaaaaggtgatgcgttgggacctggtattcacgacatttttggaggatttgccgtacagtaaagatctggtccgttgtcgatcggccgtcaacgaagccggcttgataacttcccacgaactcgtttactacgggtgacaaacgacggaagatgatctgggataatactttgtaggccgcatttagaatggtgatcgctcgaaagttctcacagtctaacttgtcgcctttcttgtagatggggcagattaccccttccttccactcctccggtagctgttctgtttcccagattgtgcctatcagccggtgcagacaaatggccagcctttccggacccatctttatgagttcagctccgataccatccttaccagcagctttattgttcttgagctggtgaatggcatccttaacctccctcaaagtgggggctggttggtttccatcttccgcaatactgacgaaggcatttcctccgttgtcccgtccttcattgcctgtgctctcagcaccattcaggtgctcgtcgaagtgctgcttccacctttcgatcacctcacgctcgtccgtcagaatgctcccatccttatccctgcacatctcggctcgcggcacgaagccgttgcgggatgcgttgagcttctgatagaacctacgcgtttcctgagaccggcacagctgttccatctcctcgcactccgtctcctccaggcggcgttttttctcccgaaagaggcgggtctgctgttgccgtttccgtttatagcgttccacgttctgccgggtcccttgctgcagcatgaccgcccgcgctgcattcttctccttcaaaacctcctggcactcctcgtcgaaccaatcgttccgtcgactccgtcccacgtacccgacgttgctctcagctgcatcgttgatggctgcttttactgttctccagcagtcctcaagaggggcttcgtccagctcaccctcttccggtaatgcagcctcgagttgctgcgcgtatgccgctgcgacattcggttgcttgagccgctctaggtcataccggggaggccgtcggtaccgtatgttgttaacgacggagagttttgggcgcagtttgaccatcaccagatagtggtcagagtcgatgttagcgccacgataggtcctgacgtcgataatgtcggagaagtgccgaccatcaatcagaacgtggtcgatttgcgattctgtctgctgtggtgatctccaggtgtatcggtacggaaggctgtgctggaagtaggtgctacgaatggccatattcttggaggcggcaaaatcaattagtcgtaggccgttttcgttcgtcagccggtgggcgctgaactttccaatcgtcggtctgaattcctcctcctggccaacctgagcgtttagatctcctatgatgattttgacgtcgtggcttgggcaactgtcgtactcgcgttccagctgcgcgtaaaaagcgtctttatcatcatcagtgcttccggagtaagggctgtgcacgtttattatgctgaagttgaagaaccggcctttgatcctcaacttgcacattctctcattgatcggccaccacccgatcacgcgcctctgcatatcacccatcactataaaagctgttcccagctcatgtgtattgccgcagctctggtagatggtatggttacctctaaacgttcgcaccattgatcccttccaacacacttcctgcaacgctacgatgccgaatccacgatccttcagcacgtcggcgagtatgcgtgtgctcccgatgaagttgagagatttacagttccacgtaccgagcttccaattcgctcagttgttcgatctaataacaaaagtggggaaaatttcctaacaaaagcaattctgccgtgttcaagccatgaattttgaaatatttgaccaaaaaaaaactattataatttcatttaaatttgtaattgtcatagtttaacctagaattaaaaaagatgactcaatcaaatagatcatttttttaaagataagaatttagggcccaaaatgaaaggggtgtaagcgacatttttttttgttttgagttaagtatactgaacaaatctctgtttcctagctttcttgtagtattttttatgtataatttgtaggagttttttcttggttctcatacagtttgtatcggtacaaaaattgctgaaaaaacttcagcagcaaatttttgtcttttacacctttttgcttctaatgctttcaacaaaaaataaaaaaaaaacatcaaaattaatgttagattgaccaagacaaatcgtacttcacgtttatcgttagaatttcagggtcaatatcaggcgtttaaaaaatccagatttcaaacggaatagtgatgaagagcagatgctccgcacaaaaaatatattagaaaggtgctccgcgcgccaaacaggctgaaatatcgacaatatttttattttcaatacttttcctcaatactttcaccgcgttcaagtcgggtcagccatgttgggttgctccgcacaaaaaaaaaacgaattactttcgttattcgtgattccgattcaaacaaatcacccgacaaacacgaaacatgcttcacttcggctgctatcggctatcaagatcaaactgagagggtgaatgatgggaaatattgaaacgcacgcatatcaaacttttctgatttcacctcaatatattgatgtcatacctttacgacatcaatatattgaagagttacgtcaatcgtctagaggtcgcttttatgtgaagattctggaccgtccgcgaatcgaaccaacttcatctacttcaactcttcttcttgacattacatcctcactgggaaagaaactgcttcccagattagtgtttttattagcactttcatggttattaagtgagagctttttttgccagagttgccatttttgaactcgtatatcgtatggcatatacattgaagttttgttacgcgacttttttttacgcggtactgcgctgcccataaaggcataactgtcccatattgatttagtaggtattgagaaaacagcgcccaaagtttgattttttttcttctcatacaaatgttcataattttctagtacatttctacactgccgttatacgcataattgtcccatgttccaaaacatgcattcgagaaaaacgcgtttaaagattttaacacatttaggcctcgtattgaccaggtgtgtagtaaattaaattaatatctttacagtagtataaagaatagcgtgttcattagagtcaacagtttgtgttatgagaaaaatgtaaatttagctacgaagttcatagtgggactgttattgctagaaatacggggtttttggtgaatttctacgcataacagtcccacagatagtagtgatcaattatgtgctaagcatactgctgtagatgaccgttcctatgtatatattgtaccgaatgtagaggacgtatatcctcgagactatgttaaggcacctaatgaaggctcaagtgacatgtgccaaacggagccacgtgtagggaagtgaagaaatacgattttatagtttgggatggaaagcaaagttttctgtttgtgtgataatgagaaaatgtatgagttagtgaaagaaagagtggatgagtaagttagagagtttatatgatgtaataaattcctatatcgacacttccagctgcaggcttgacagaaacttatcggcgaattcaaggttatttagcggagtaaatattcatctcaaaattcaagacacaaatattcacccgattttacatttcttggacttggtttacaaaatcatcgcaaattaagtttaagaatcgccaacatatttgccacttgcaccgaagaaccagttatccagaataatgtcatcgaaaacctcttgaactattcttcttttgacttgatttgcaaattcatgaagtttggggactaagtttcagaaccgacaatttagggatctttcaaatattacgtaacgcaacagggggagagatggggtcttctgttgtgttacggtccatacaaaaaaaaatccatacaaaagatgttacatgggggtctaaaattggccaatttttcgttacgtaatattttaatcatcccttagtggccatttcccccaggacaccaggaattcggaacaatctgaaatgtggtcaagccattcaaatacatctgaaccacctttagtgaaaattgatatgtcgcaagccaggtttcagattcgccaatatgatggccacttccaccagtgaaccggtattcggaacaacccagtacagtcgaatttcgttcgttgcactatctttaaatgggctacgttttaattgggctcccgttagttgggctatagcccacctaaaacgaagacaaacgtcattttctgacataagaagcaatttatcaatgttggtagctctgtttttcttttgttctatgttatttgacagctcgaaacttagcccgattagtgaaattctttcactaaatgggctacaggtttagtgcaacgaacgaaagttgactgtatgtggcaaagtcatccaaatgatggtcgaaccatttttatttagacttggtttgcttaatcatgaagttgatttgtcgcaagccatggactcgaaattaaagtggtactgattcttcaagtgggattacttcagtgctcccctcgattaattcaaaattacggtaaatttctaatcgaaaaccgcggttccaaaaactagaagaattttgtgattgaccctgaaaatccaactaaaattaattgaaaaacggatgggaaataatattttgatattgaaaatttcaatcaaaattgacgttgggctcgcatgaataatgaatgcatcccgataatacaaacacataaaacaggttgtgttccacatgggatgtaaagccaacgtaagaagatattcaaaacgattttctcaaacttcagctaaataaacctgcctacagaatattttgttcgagatcagcgcagcgaattgtatagtgtgacagtcatgcgtagaaatacagtagtgggacagttatgcgtagaaattcatcaatgggacaaattgacttggtttgcttttcattgagtttccgaacaaagttaatttttggtaagtgttttctaaaactatatgtaaacataaactgttagatgaaaaaaagtcaaaatgcacaaaaagtaacatgggacaattatgcgtataacggcagtacatgcaatatatatttaacacaatcgcacagataactcattttgtttatattgatcagcaaaaaatttaaacttgaacacaattcacgttttgcagctgctattagagtcaaaatttcatatagagacagttatgcctttatttttcaatatgggactgcactaacttcatgtttttccacaacattttcaaacaaagtgtgttaattttcatatgcatagtaaagtatgtattaaaacatggatgttgcgatgaaaaaacgtgttggttcgaaaacccatatgggacagttatgcttttatgggcagtgcgttattttgaaaaccgacgaagaaaacgacgtaaaaatatcagcattttttcaatacaaaacaatgttctacatcatgattcgtatggtcgtgaaacgtcgagaaacataaagatttttacactttgtttttgaaacgacacggtttaactttgttttttttttttaaataacatgtttttacgcgggacgttgaccgacgtaaaaaatccttagtgtacgatgacactctatgagaagtcaaggaaacttccattaagaatacatcttggaagatcgcctacataagattcttgaattttccacaatccatcaaacatatttctttcatttgcattccatttgtgtagtgcgtgactcccaatgggcccagacgagtggaagttttaacagctaccgataaacttctgcgtccatgcgtcctcgtgtcgaaacggtaacgcgcgatatttctcgattacctttttaaaacgacgtaagaaacttccatacacgggaaaaaattctgtggtaaaagttactattttagctgactacgcccattcttgaaactaccatggaatttcagaccaatttactatgtttacggtacattccaccgcattactggtacaattgacagaaataatcaacaacaatcggatttcgacaacagacacggtaaaatcaagcgcatttctggtctgctgaaaattgccggtgcgagcgcttaagttaaccccctaatatggtagtttttaccgcacattttttttgcgtgtacggttttgagaaaattaattcagaagaatcacaacctgtcttctaaaactgttttaaaatgaatcaccttaacattttttcgccgtgtacattgcttaaattttccatataataagctcgcgataaaaaactagggagttcctgttatttcctacaacaaatttattacaaaatgataagccgaattattcagtcactttcgacgtttttgtatcagtgtaaaatcggctcaagtagtgttttgttttgattcgtggataagtcactttgtctctccatacagcggagcggcgaaaggagttctgtttgatctttcgaccttgacgcttgcttttgccggagcgagcgacgagggcaggatcaaacatgtcgcgcgtcgatctcgtaagtgaaaaagtggcgtgatcggggagttcggttggagtaagttaaaaagtgccgcgatcggttcgttctttttgatctttcgacgaccttgacccttgctcctgggcagtgcgtcaagaaagcccgagctgtcgtccgtgtttattttcgggtcgcgcgcctattttttttttcctgagtgctagccgagcaatcgagtgaagctgaaagtggattgtggctgctcagtcaaggataacggatcaattggtgagctcgtttcatgctactatttctaatctataaaatatgtatgactgcacaatggtggaatgtaaatatgatttttcaacaaactatggatggttcgtcactgtgagtgtcgacacaaactctgattcatgatttatttatgtttaacatttttttttcagaacacctcttatatacctttatttttgtaattaaaaaaactttgaatggttcgacactacaagtgtagacttgcgaaaggttcactttattcaacaaactttggatgggtcgccactgtaagtgtcggcataaaaataagagtgttctatgatgtcccaaccaattgagtcttttgtttcttttcaaatgagtaaaatataataacacatgctttcgtactgacagctgtaggaatgttacatttaggtatttgttcaacaaactttgaatggttcgtcacatcaagtgtcggcataattttcctctacatagaaattatatgaacaattatatttacgtataagcatgcgatctcacaaatcattgtttatcatggtctaatcgcttatcaaagtgaatcctttgacccaacgatcctccccattaacaaacatccctcccagtaacctttgtggagatgcagaggcaaacacggtctccaaatagcaaaggttacacactaacattccttccctcaatcccacctgactgcaaggacgtggccggcgccgttattgaccttgtataaatagaggcactgaattatgcacactgaagaagattatggccaatcccagctgaacttctagttgattctttgtgcattttcactgacttcggtcaatcacggaatagcaaccattgatatgtgtagtcagtctaagctaagctaagctaagctaagccatacagcggagcggcgaaagttgtggttaggtagcgaaagttgaaaatcttgctttcgtcgttttgtaaatccggaaagcaaacgctctaaaagtgaaaaatcgagttgttttagaacgaaatgtgtagaatttcgtctgcgaaacacgtagaatcgataaagtaagtttgtatacttttttgacttgaggcggtttgactaagttttcgagatttagcgaattaggttcgtgagttctcgattctcaattctcacccagaggacgcgatttcgcaaatttcacttcaatttaaccaatgcaattgcaaagtatatttaatgtttagtttttcggtaaacaataaaccagaatcaaaaaaaagtcttgatagtatattacatggcgaccgtgaccactattactggaacatgtgcctatattgatcattctaaggttatattttacgtgatatagaataaaaaaaatttttcaatgacgtattcagatatgaaaaacaagcctccgtgttttttttgtcgattttcatttcctcaaccttttactactggatggatttttgttcagagaagtcaattaaattccattacgaaaagaatttggaccgtccgaaaccacgacaccttcagtatggctatgatttattgtcgctaacgttactgaggattacaacttattattccaagaatatgataaagattctagcaccaattctaaaatgggctttcaaaataagttgcttagttatgaaacaatttcctaaacctttatcttccctttgcattcctcaggggtcttcacgtgatgatgaaggaccagtacgccaactatgtggtccagaagatgatcgacgtgtcggaaccgacgcagcgcaaggtgctgctgcacaagattcgcccgcacatgaactcgctgaagaagtacacctacggcaagcacatcattgccaagctggacaagttctcgctgaaaacgccgaactcgatcggtggcggcagcggtggacccacgggtgctggcggcgtgccaagtggaggcgtcgtcggtggcaatggcagcaccgggtcgtccagtagcggaaacagcaatggcaacggggacgtcgttggcactaatggaactaacggtgctggccaacagttggtgccgagttcaaatggaaacgggccagccagtaatggaaacagcgtggtcgttgtcaatagcgccgggaacggtggagtgacgaatctgggtcccatcgggccaccacccaccaacggggtggtaatgtaagctgtacgaagacagcggttggtcgatgattaatgattgtactgtattgggagtttctcttgaaaggtgagaaaagttagaatgcgcgcgcttggtcaatagtccggatgatgtacaccaaaaaaacaccatacgaacgaactcaaacagcaaaatgaacaaaaaagatgctttacgcttctgcacacgggaatgtgccttcgatcgccggaggaaaaacggccacccacaaacacacacacacaggcgggaaattgtgtggtggcgcaacttttattttgtaaagaaaccatctgtaaatattttccctgtttttttttttacattcggagatttttctctgtcgaatcatatgttagtaggatttgttttaaaagtggcaggatcaaaccgagaaagactttcgattagaaatactagaaacgacgcgacgtgatagtataaaaactgttctgcgcagttcggatgtatacaatcttcccctcatcagctgtaataagttattcgtttataagaagatgcagaagaagacacggatctcagcccaatttataagtttaaaacgtgcaagactatatataaactgttcggagacagttc

SEQ ID NO: 203 - DNA, 9532 bp, Aedes aegypti; identical to SEQ ID NO: 65

SEQ ID NO: 204 - DNA, 9126 bp, Aedes aegypti
ttcttgtttacggcgaacccaactttctatcgaatcctattcgtttgtgtctatccagggacatcccgggacgaaaatcccgaagatttcgaagaaatttcgggattttccgtattccaggatataattttgaaattctgaaaatcccgagattgccgggataattgtaaaatctaataaaaacctaaaatgttaaggcagaacgatagcaattttgcatgaaggaataaacagtaacaacaaaatctaatatgaaaaagaaaaaagtcaattagattcaaaaaccgtctcgcatactcgtaacttgtcgggatacaaaaaacttttcaaagacttcaatgaaacaattagaacatataaaaaaaacgtctcattacgtattacgtattttttctgttaagaaaattacaaaaaagacgtaatgtcaatttttggaattttttaaaaatttactatcgttaaaccgatattgcctttgaactcgtgaaaggaaaaatcggtgaacaatatttgttgaaatccaagttatgactgaggggtgctgtgagaattcgaattttattcaaatgggagcctccaaagttgaccattttgtatgaaaaagcaataacgttgcaaatgttgtgttaatattgggcaagtataagcagattaccacaatatatgctacttataaatatgataaagtaatctataaatgtgatagtaactactgtcagattgtcagattagaaacagaatgtatgtaagacctaagctatcaatatgtacacattgtcagatgtttggcttgaacctggcagctgttcaaacatttgtttgaaagtaacagaatttcactagttcacttatgtttggctctcagtcaattatttgatcccgtatactacaaggcctggtcaggtctgaaacatttccaataagaacaacattcgttgaatgtgtcatatcaaatagagtaaaagtcattgaaatcttgattgaaatcgtcatctcaattatttggactgggttgagccttcgaaatttttttcgcaaaatcccatttttagtgaaaaaaaacaacgttttgggacattcgaataatgtaccaacaaccaccttgaccatacagagcacaccatatgcttgattatgtgcgatcaaaacaaacccactcgggatgctgcttttacttattccactcttccttttgcatcactgctaaaaattctgcgtagtagatttagataataaacacattcactcggcagatagacgcagcagcacgttcaaggtccaacacggtttgagagagcgcgtgaaaaggcttcgagtgtgtgttgtttgtagatccgatcgtgtttactaccgtttagatcccgttattttcagtgggtgttgaattatcttatcagtgtttcactcatgacaatgattgcctacagtaagttatactgataaagatgggtgaggtctaaatgcaaatacctaatcaatttgagcacatacaataatcaacaatcaccttgaagatcgcattaggcgcgtaaatttatttttaaagttcagcatttttcctttcgcttctttttactctgtttgcaaaatacattcaaacatacgagcggaagcatactgtatagaatactaaatacctaatctttgcatattagcgcaagagagtgctcagggtggacgaacagtattgcatgtctacaatccgctttggactgtcgtccacacacacacacacatacagaatagcgggttaataataatttacaccctctgatgtggggatctagctgcttgaagacggtctagctgggctcagttagccggtaaatgtcttacggaacgcaagcaagtggaaatacaagcacctatatctagtgaataagacgacgaccgcgaaatctgtctttgcattcagcgcggtcagacatctatacgtacgtactttaagttagtacggcacgagaagatgggcaaaaaatggggaaaattgtgtttacgtagaaacctatataattataaataaatagaagagaagcattttagtgagtcagaaaaccgcacgtgatattttttagtaaatggaaaaaagtgttctcgattaatctatttatagtgtgaaaaatacaaacttttgccaaaatcctatattgtttttgatgtgtgatcatttgcctctaaacatcgttacttctatgaagactacggtatcatctgctttacttccgcttgtgcctcagaagattatttttagcagattactgatcaacaacttccttcaatagaaaggtaggtcacattgtcagcaagttatatttttcacgactctttctctcttcgcatgacgttcagcagttcaagcaaatcaaagacgacaaatgcgcttctatagcttggagacggtgtctcgtaataaataaaaataacgaagggacggtagattgctataggtagaaatgagttgtgttgtttgcgcctctcggtgcgaatgattcaatgatttattggattcgttgtttcattccacatggcgaaggaaacccggtcagaatgctggtcttcctaccaaacaacaatcgaatagccacgtcgaaggaagataacgtttatcacaatctacctcgacgagtttgtttccaaaggtcaaactccaaaaatctgtggatggagcaatgtcatttactgaaccagtttcccctatgtacgtgagcactatgaggaaacgttggccagcaagaacagcacgcgtgtaaattgttctatacacctcgtgtaatcattctataactttagtcgtggtgtcatgacgcagactctgacttaattataatttgtcccagttgataccaattgcatattgattattctcttgtctctctttcgttgcaggctcagtgtgtttgaaacacctcagttaaacttgttgaatctagtacagtgtgataagtctacgagacattaattcaaaatgaatagtatcgcaaaagtgtttaacaacttcaaggagttctatagtgaaatcaatggtgctacgctgactggggcgatagatgtaatcatagtagagcagccagatggatcatttgtgtgttctcccttccatgtgcgcttcggaaagcttggagttttacggagtcgcgagaaaattgtagatattgaaataaatggcgaaccggttgacatacacatgaaactaggtgaatctggtgaagccttttttgtcgaagagtgtctcgaagaagatggtgaagttccagctcatatggcaacctcgccaattcctactagttcgttcattgagttcgctcgcgacacttcaattgtgacagttacgcaaaatttagaagatgagaatataccaagaccaaggcgtaattcgatcgatttatcaaaagaaaataccgaatcagataaatccaaatttgagaatcaaaaatccgatttcaaccatcgacggcacactgataacactacaggaaggcccgatttgactttgaccaagaaagaatacactactcagaagattcgccaagaatgggctgaagcagaacaggagcaaatcttccaaatggacggaattgaaaattcgacaactgattggcagaatagcacattgcttccgcctaacaacgaagaagacaaacattttaaaccaatcgaaacagttcctacctcaacggaatctaaactaacaaattcggagctagcttctcaagaagatcaacaggcacagttgctagaggacaagactaatgcggattctaaatcaaaaaagaaacgcaggaagcgatcgattatgaagaagaaaaattctcaacgcaaaaactcgtccagcagttctggaggatcaaaccattcggatccgaacgatggcgttgaaacagatagtattactgcatcgcaacctactgcctcatcagctagtggatctcccaaggaaggtgaacctgaaaatttaacagctactccagcagaaaatgcaccaaaagaaattccagagctatcaaaccgaggtcatgaattagatattcatttcttcagtgatactgaagttacagctggtgttagtccacgccaatctcgcccttcaactccgatacaaagtgacacggagtttgaaatttcacaacgcgagaatgttgaaggcgatagcatgtccgcttcttggaagtggggagaactcccaacaaaaccagaagagattgaagatttgagtacctctcagggcaaacaagctcaacgtaattcaatgctaagtggtttgatgagttttatgaaatataacaacaagaaaatgcggaaaaatgttccagatggtttgtatctttcggatcttgacgaatctttggaccctgaagtggctgctctctactttccacccgtttcatctaaagcacagcatgctcaaactgaagaagacagagaaagtggcaatgggacatctctgccgcatagtccgacatcgctcgaaggtgtgaagagtctggattccgattttgacgataacaaggataaactttcgttagatttcatcgctctttcactctgtggtggtttggacagtggtacaccaacgtatgaagaatttgaaaagcatcgtcttcagtacgccgatgtctgtaacagtccgaccattttttcatcaccggatctagtagtgagaatcaatgacaaatactgttcatggcaagccgcttgccctcaggtgatgactatgcttgcattccaaaaatctcttcccactgagcaagccgaaactcctagcaaaccgaaatcactggacgtcgctacagctggttctgtagaagctgatgcacaatccaccaagcaacaagtttcgcagacatcttcggaagccaatcgaggaggacgttggtggtattggcgtagatcgaacgacaaatcaaccatgaaaaccgaaaatgagactgaacaacagtcgaaaacttcggctatagctactcagacttctcgatcaaatactccggaagatgttggaacaatgacagaaagtttcagcaagactaaagaggatggatataatggatctctaagttcggaagattctgagctgccctcagatcagccaacaaaccaggagctcattttgaacaaatcggacagtttcattgagaaataccgaaaaacgcttcgcctgtcgtccgaacaaatcgaaagcctcaatcttaacgatggtatgaatgaaatcgtattcagtgtaaccactgcctaccaaggaaccactcgttgcaaatgctatttgttcaagtggagatacaacgacaaagtggtgatctctgatatcgatggaaccattacaaagtaatgttttaacgcataagcgagaactggctgaaattcgctaaccattttcattatcttcctacagatctgatgttcttgggcatattctaccaatggtcggcagaaactgggaacaaattggcgtcgcccagctcttctcgaaaattgaagaaaatggctacaaaatgttgtacctttcagcacgtgccattggccaagcgaaggtaacgaatggtaatttttatacctgtttcaaatactgaaagctttgtttctatttattcccagactaccagagattatttgcagtctattcggcagggagatgtgaagttaccggatggtccgttgctcctaaatcctacctcgctaatgtcagccttccatcgagaagttatcgaaaagaagccggagcagttcaaaatagcttgtcttagtgacattcaagctctgttccctgataaaaaccccttctacgcgggatatggcaacagaataaacgtaagtatttatttgattttgttggtagacagttttatcatttttcgttcaattcttcaacaggatgtctgggcttatcgtgcagttggaatacccatctctcgcattttcaccatcaacacaaagggcgaactgaagcatgaattgacgcaaacattccaatctacgtaagtatcttgtataagccattcggcacactgcactgtggtagaacgtgtgtgacgtcattgtgggatgttgtcgcatttaagctttcctatgtcatacgggttcacatgtaaagttgaaaaaagaatcaactaacaaatacacaattggaaacaaaggtatacaaaacactacacagtcaattattgtggcaatctatgagtaccacttgcaaattttgtacaaaacgtcatctgattgatcactaacacatatgtttctagcttataagctttagttttacttagttctaataagtttttgttttttcttattattttttatttactctaccgaaatgcttccacaaacaaaacaattgtacaaattgtaaaactacacagctatgcggggcagtcattggtagtcaatgatatatttccgcccataatacgcgagtcgtcatcagagtctgatcagtcagactacgatcaatacgacgacaatgacgacgaccatgacgaagccgatagctgcttcgaagaagctgattttgaaagaactgattcaatgcaacgaattaatagcaaaccaaaatttaaacaacgatccagtggtcgttgcccagaatatgaccaaccggaattgcagtttccatgtgatatagagtactagatgaccacgaggggcgacctaggctaaaagtgataagactgattttgaagcagagtagatttacataactgctattttgattaattacaaagcacgctagaggcttatgtacgttctatttttgatggtaatggaatcgtaacgctagtcaacgaaaatgactttttccctagcgatgtaggcttgtatatgaatttatactagcttttccattagtttctgccatcaatttgctacgggtaagcaaatgtatagtacctgataagaatatcatctccatcaaaggttcaactttaacaaattttaacatttttcaacgattcgcaacaacgttcatcatggcttcgatttcatcgaataacaaatcattgaggttcatttggttcacatataatacttcataaggtattttgatattcgtttgcagaatggtcaccaatacacaaaattagcaagatacattgcttggaatcacggtttgtcaaggtgtaaatttgataacatttatcttttagaattggcttgcattttacctcatccattgcttatcattgttcatttataatcccctttgtatacatgttatataattttctcccctatataacttttatttacagttacgcaaacatggcatacattgtagatcaactattcccacccatcaaacacatagaagaagaggatagcgagttcaccagtttcaactactggcgggatccagtaccggacatcgacttgaatctcgatttgtccagcagctctcagagtggaagcggcagttctacgccggtatcgcttctatcgggaaaagtaactcccactagcacactggtacaacaggctctacctactattccggaaaattaaaccatcttcaatttcgttttccaaagataaacatacttttaatcgcgtatcagtatcgtatcagacactaagtgggtaagaataaatgtaaacgcatataaactactagctttccgtacagatataggcttaagccattataatcgaattattgacaaaatcgaaacaaacattgtgaaccacaccaatgcatccttcaatagcttagttcttgtcttgtccttgtattaaattatagttcagtttgtcatgtctctctagtttgcctttgataggcacatgcattaaagttcgcagcacagccacgaagagaaacaaatattaaaatgctccaaagcagtttacaataataatattgatttataaaaattaggtatgaaataatttaaaaaaatgctgacgtgtttgtaacaatgagtgctgatctattaccaagcacgaaatcaagcgttgctgagaacgatcaaatttgcgatgatacgaaaattcatcaaagcatagcagatagttaatgaactattgttgagacgagcagatggaacagcgagtctgatccaaattgagctaataacatgtgataataatttctatttatatttttttttcgttttcatatattttagtttgtagttttcaaataaatagcagcattacaaacaaacgtaaacagtagcaaggttttatttgttcttttttcataatttgcatgtggcccaacaacaggcaagtaccactcagttacgctatcttttcggtgcgataaggcttatcagagcagaaaattgattttatggttcttaccatgcaagtcattttgtatgcaatcgctcaaccggatgatgacaacactacggtgaatgaaaaagcctgtgcatccaaatttcggtatgaacaaccatgcaatcttagaaagaaaaccaatttgtgtatgttgtcgaagtttaaccatgacggtgatgcgtaagtttgtcatttcaagcgcgtaaagaaaaaaaaaacaatgaatagacgctaaagtactgtgcttcagaaggtttgactcatttattgtccgaacttaattccatgcaggaaaactaaacatttaatgctcataaaaaatcactttcggtacctgaagtaattttcttaatcttcacgcaagcgaagagccaaatcactacgcgtattttgctaaatcataaaaaagagcctttgtctaaatttgcggagcttcatacaggaagacgggatttgggtctaatggctaccgcttctgctccataagcagaaggtcataggtttaatcccaggcccgtccctttcctcgtactttgtagttatatatctctcacttgcttctatcttctattcttaatctatcacactcaaaaaattattcgttcatagcaaacgctagaaccagagacggacaagaaaccgtttccctaacgcttccattattccacgcgcacgcctttcctgaagcctgatacataggcagtctgctaaccagacaatcaaacctctctgccacgcctttcccccaatccatacactcctgcaagaactggcgtagatgcagtcggactccacggtctacagtgggccagtataagtgcaacatcatttactccctcttctccacattgg

SEQ ID NO: 205 - DNA, 12374 bp, Aedes aegypti
  misc_feature (5754)..(5853): n is a, c, g, or t
caccaaaccggatcgcgccagtgagactcgcgacgcgcctcaactcgcgcgattttgaaatcagttttttagtgtggcgctgcattcttacgatttttatgaacacagcgcactattcacatattagctgcgacgcacggggcccgagaaaacaataattataaataaatgttggtcttgatttctaccggatacataatatttcatttctcttatgaacttcggtctaaagtcaatctgaatgcacaatatgaacatcggtctaaagttaatctgaatgcacaataccaaccacgcataaagcgccgcaatgaggctctgcacataaatgtacctcttcttttcgctcttacatgaaatttgtaaacaacaaggccagcacaagtcaaaatcccatacaaaatcaaaacagtggagtggtctattcaagcatacaattatgataaaattttcgtttcaatcccacagtgcaaccgccatcaaaacgccaccaactctccatttgtgtagacattgcccgttttgacagttcccatttgcgtcctccgacccgagcgctgtcaaatttcaatactgccaactgatgacaacttccttctttttcggtcttttcgacgtgaaacgtgctgaacactagaaaggtgctttgtttttctctgcgaaatagtggtgaattgtgtcggaaaattgtgataaaccggtgttttcgcttgctttttagatgccagctgcggctaagactgccccggccacgaaggccgccccggccgacaagaaagttcaggagaagaaactgccagcggtgccggaatcgaaactgaaggcaaccaaagtgaagacgattgcccgtcccggcagcctccacaggcgtcgtcatctgttggctgtcaagctggtccgccaaaagcagaacctgctccgtgcggccaagtatgccaagaagtacatccggatggaccgcgatgtggtcgagaaggcccgcgctgccaagaaggccggaaacatctacatcccggccgagccgaaggttgccttcgtgatgcgtattcgagggtgagttggaattcgttttctttttgttagcggaagaaggaatattgtgcaaggatgtgtgggatgttcttgtgtgaagtgtctggtgatcattgtggggaattgaaaacagtgccacaaacgatattgttttcggaaagaaacaatcggcgaaaggttaggtgcagaaatgtgtcaacaatgctgtggcagcgaccgtataatggcgaggaattatacccggcgagcatgcttgcatttagtggccacgataattctcgcataacttctgatctcgccctaaaagccattggtaaccatgagtgtagctcgttgtttctgagcatttgaatggattttcatgctatttaacaacgctatgaggaagaaaggatcattatctacctgcccgtgatgttggtttggatgcttattccttcttctgcccagaaacaacgagctacacaggtggctaccaatggcttttaggacgttatctcagagtatgcgagaattggtcgacttaggcttttgtcagcctagtgatgtactgaattgacgaataagaagaagtttaccaggcagggctgttagcaggtctttatttagagacgtgttcactagttaatgcaagactttaaaaagtctatacttccaatggaagaaagtctttcaagtctctattttagtcatcagttttttttttctgattctgcttgcagggaatcctgctgccaaattaaatgtgttccagggaaaccttcagaaactattacgggactgttcagctggctctttaatcatttcttctaagattgctcgaggaaaagcttcaagaaatatccttgtgatttctccagaacatttccagggtttcctatagggatctctccagaaattgttctaaagatttctccaccaactcttccaggatgctctgagcaatttctccagaactttcagaaatccttgagcactccagtaattaactcaaatatcacattttttttttcaagtgttatcctagatttgttgaaacatttggaggaatttctgcagcgatcttagaaggaatctctggaataattcctgaaggtatccgcaaacaaattccttgttgaaatctttaagaaatcctaaaaagcaattttatgggaaatttctatgaatcactggatgcatttttggagaagattatctgaccgacaatcttggaggatgtcttatggaaatcaacggaaggatcactggataaaatcctgtagaagttaggattttcttggaaatttcctaaagagtttttgaggtaaatctgatgatttctgatagaatctttggaccaattttttttgtggttatctttgggaaaatccagaatggggttttgagatatccaaaaccaaaattcttggaaaaattccttaggacaattattatagaaattccatgggaaataatccctaaatgaactccttgagaaattttcggagttgtttctgatatttttagcaaatacttgaattaatttctgttgaaattccttgaggttacaattacaaaccagaaacagtaatacgagcagaaaaaaatatagtaatgttacgaggaatttacattcttgactaattctacaccatttgatcccataacaaatttcagcgcgattgggagtgttttggaaagcccaagcaagacgcttcgttttcgggtcgccgggagtttgtttgtgtttcgtttcgcgcattttgctgggcagtgcttcggaaagcccatgcaagacggttcgttttcggggcgccgagaagtttcgctgttcgcgctgtgtgagtgcgaaaagatattcgtgttcagtcgaggatggattaccaactggtgagctcgtttcatgcttatgataacacattttttttcatgaaagcgttacttttatgtaatattcaatctaactttgtgtgattcgtcactacaattatcggcattatgcctgttttatacaattccaatatacatttaatattttgacatcacttaaaatattgtttgaattgttcgacattatgaatgttgacgtattttttaaacttctaccaaagacttttcatcttgagacaaaaatgcacagcaatactattataaaattttcaaacaaactatgtatggttcgtcactacaagtgtcggcattattcctgtttcatataatttaaaatatatgcatatatttttctctcttcgccattaataaaaacttcttttgaatggttcgacattatagatgttgacgtttattttaaatcttctaccaaaaacttctctagacaaaaataaaaactagctttagtcgtatttttcctccttatccatggatcgcatcaccgaccaaaggtgactcccagatcttttcctcctccactaataaacacccttcccgtggtgattgtggagatgcagaggtatcctcggtctctagaagcaacaatcattacaccctaacattcctttcccaccccaactgaccgtaaggacttggccggcgccgttattgatcaataatattagatctgctaaaattgcactccgagagtaagcggaaactcccatcccttattcatttggatcgcagtgcaattcttaccagttccgatcaatcacggagtagcaaccattgacatgtacagtcagtctatactatgctatgctaagcataacaaatttcagcgcgattggtgaagctatatgaagcaacagcccttcgaagtttgtattggatttattgtggaaaaactgagttttgtacttttgataaacctcgataggtatttttaccatgaatggcattggcgaagaccgcaaagcaatccgatgcttgcgaaagaagtgaaacttccatgtaggatataggagctggatcatattcttgacacttttgattcatttcggcagttgggttttttgaaagctactgagctcatatttgctcacaatatgcgccccattgaagggctttttatgacaaagtttcagacaattcggccaagaaaaatctcccttgccaaggtgaattacggagtgcccaagtagctctgcgccatacctagtttcttttcttgaaaaaaaaaaaaagttgattttttaaggtatcttaaacgaaatttatggaggaattctttaggggtcttccattaattaggtaagggttttggggggaggggcaggcccggatttgggggggtgccaagggggcaaatgccccgggccccccgattaagaaggccccccgaggaatcaaaattaaaaacaaaaaacattttgaaatacctttcattatttttctttagacatttgaataacaactttttaataagtagatgaaaaaaccgaatttagtactgtaccatttaattccactagagtttgtatcctttgacagatacgcgtatttctcatctacttataggtattctactaaacagctcgaagatttattaacaactttctaatatttaagtattatttttacctaatatctgaatctcactgtatggtttggtcaatgcttatccttcaacattttacagaaaaaactgtttgtttctgtttcatatgccatagttgatgaagtattcttcaaattcagtataggcttagcattgaaaataatccatagaatatacaatacaggtaagaaaaaagtacaaaaggaatttgagttacatctcataaataacttgaaattttattcattggaaattaatcaaattctttgcaagaggccaaaaacgaacgaaactgaaattgttttatttttcccattggacggaaaaatcaacttaaaacacttgtgcttattctgcgcggcgtgtgagctgacacgagttgaatgaggtgacaattatcgactcgttcccatttgattaacattagtcgtctcacgtcactcgcggtgagagcgagtcgtctcgactcacacgccgcgcagaataagcacgaatattgaaaagctcgctcaaatttaatacgttggtttgtggaatcgtcaaacgtgctgaattttgtatacagtgagaggcaaaataaagtgcccaccttaccagttttcgaatttctctcattgatttggttcaaattaaagttaacacacctaaatcttttgtgatattttatttttgatgttcttttaaagttgcacttacgaaattttgattaaaaaaagaattttacttaaagaaaaagaaaatcaatttgtattgaaaaaaaagtagtgacaaaaataagtgcccacttccttcttggccccagaaaagatgatttaagaaaaataaaaagcaatttaatagttaatgtgtcctcctttggccttaaggacttgctggaggctcttcggcatgcttttcaccaggttttgtaggtgttgtggatctagttcttcccaggcgcgctccaaggcttcaaaataattatttttgttggtaacaccagttttttcaaccctagcatcgagaatcgcccacaaattctcgatggggttgaggtctgggctttgtggaggccattccagcggtttaatccgacaagaccggaagaaagacttggtcttctttccagtatgcttcgggtcgttgttctagagaaatatgaatttctcttcaaggcccgtctggatcagcgaaacctccagattccagcaagatgttaatgtaggaatctgccgtccttattccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggatgtggcgctcctgagctcgagctgtctaaccgagagcggcgggctcgtgtgtgatgcagagcaccacatccaaggaacggtgaagcatggaggaggaaatgtgatggtctgggggtgtttttcatggagtggagtagaaaacctcgtgaaaatcgacggaataatgatggcagattcctacattaacatcttgctggaaaatctggaggtttcgctgatccagacgggccttgaagagaaattcatatttctctagaacaacgacccgaagcatactggaaagaagaccaagtcttttttccggtcttgtcggattaaaccgctggaatggcctccacaaagcccagacctcaaccccatcgagaatttgtgggcgattctcgatgccagggttgaaaaaactggtgttaccaacaaaaataattattttgaagccttggagcgcgcctgggaagaactagatccacaacacctacaaaacctggtgaaaagcatgccgaagagcctccagcaagtccttaaggccaaaggaggacacattaactattaaattgctttttatttttcttaaatcatcttttctggggccaagaaggaagtgggcacttatttttgtcactacttttttttcaatacaaattgattttctttttctttaagtaaaattcttttttttatcaaaatttcgtaagtgcaactttaaaagaacatcaaaaataaaatatcacaaaagatttaggtgtgttaactttaatttgaaccaaatcaatgagagaaattcgaaaactggtaaggtgggcactttattttgcctctcactgtaaaagggccccctttgtgagatctgacccgggccccctgaagcccaaatccggcactggggaggggggtttgagttttcttacgacccatataaataaccgcctcttaagcaggccgttaaagaaccaatattatggatattttgaaaaatatacatacaataatacgagtagttataacttgtaacgtcacgagtatcatttgaagtgattcccaaaaaacttaagaaatatccatagagaaacgtctgactggattctttggaaatttcttatgagttttctcatcttctggtttcaatttggtttatttttgtttacttagtttccgtatggttgcttctacagcacattttttttttgcgtgaatggaattaaaggcaaactacttagtggggatcttggaaattcagctaaaattgagtagttaggctctattaggcagcgtccatttattacgtaatttcaaatttttgtatgagccataacgcttgaaccttttccccccttcccctagaacattacgtaatttgtggattccgccttaggctcaactacggagctgcgttgaaacaatccaaaattgagtggaaatgcgtctccgtgtagaggatccaaaaattcatacgtgactcgctcacaggttcaacatgatttcagtcacagattcctgaacacctttaaaaatccgtccaaaacatcccagtgattcgtacgatatcttaagtaatgcttagagaaattctttaagaatttacttcagtagtacatcgctggcaacttgtgttgtttgtcccactcttcttcttggcattaacgtccccactgggacagagccagctactcagcataatgttctaagagcacttccacagttattaactgaaagctttctttgcctaagttgccattttcgcattcgtgtggcaggtacgatgatactttatgcccaggaaagctaaggaaatttccattacggaaagatcctgaaccgactgggaatcgaacccagacaccttcagcatggctttgctttgtagccgcggactctaaccactcggctaaggaaggccccccatactcatgcaaaaaaaaactatacaaattcatagaaacccctaatgacaattcgtcacagtttaaattcatcgctttgccttatgaaaccaaaatttgggaaagatttaaattttcgcagcaatctggaatcgaacctcgaaccttgctctcgataggtccgtgcgtacattacgctcctatcgacgtattgatgtggagtgatgttaaaacgatacataaagcgttcgtattacaataataataataaggcaaaacgtatgaatttcgctgcgtgcaggctttcctccatatattgtaccaccaattcttttaccgatgtctgcgtttgattcctacaggaatagcgttagcgttagcgttagcgtagttacggtatacttcgtagattggatactagcaacattcatgtttctttttaataatctcatcctgactactttcaagaacaaggcaggggagtataccttgttcatatcataaacaagaatactaaaagcacagagaacagacgttcatcttttctcgtcagcgtgtgtaaagcttgtactggtcatttcaaagtatgtcgttatgctcctgttacgaggcgctgtcgtcagattgagaacgctacaaatttgccgctttttacactttggcgctagtgtcgatatcaaaaattgccacttgtcgctagcgttgctttgtgtgctaatgcattttgacgttcactagtgacatcgtgttgtcgaaacgagtttgtatgtcgggctgtctgcgttggtggcgctgatggttgattcgaacctttacacatgtttcagatgaaattttgttcgagcccccatgtctgttctctgtgctaaaagcatgaatatcgctattcccggccacgcccatctttaccgtaacttgggataggggaaggaaatgttgatgtagcacttacttaatgagaggccaccgactcagcgacaccctcataagtgctacggagttggaggttggggaaggtatattgtcaggattcgcctagaaagctggcgatagaccataaatatttgttgtttaagcgttttcaaattaatcttttgaatgccggcaatcaaaagagaaaacaacagcttatttatagtataaatagtatttcgcgaaatacttgtcgattgtgcagtaatatttttgctcaataaccagtaaaaagcaaaaccgatccctccagggtcatcggaaaaaaatacgcgtaaaaaaaaaaaaatacgcgtaacaaaaaaaaaaatcacgcctatggatcaatttagataatcgaaaaacgaaaggaagcgcgttcgaactaaacaccctaggataacacagtaggtttttctgctcaaaattatacgaaaatcagaatcgatccctccagggtcatcgaacggttaaaaagcatccacaaccgattgttagttgcgtaacacccgcccggacagaatgcgcaatctgaacataattatcaaactccgaaaataacgttatccgttcaagaaacgatcagaagttccacgacgcggacaaaaacgatccggaaggctcacaaaagaaaaagtatcatactggaacaaactcaccggattgattctctaaatttatgtgctgcctgtcacttccggatggttcggtgaacttagggcagccaaaaaccaacagtactgaggacacaaatcaaacaaatctctttttcatttttcacgtttcactattccatttctgtatgtaaaaactgtcctgcttgggcttcatgaagcactacccagcaaaacgctccaaaacagaaaaaaaaattccagcgacgaaaacacgcgcgaaaccgtgagctaaatctatcggacgacgcaaaaccgaactgtcctgcttgggctttacgaagcactcgtcgaaacgaaaaacaatctcctggcgtcccaaaaacaaaccgtcttgcttgggatctccgaaacactgcccagcaaaacgcgcgaaacgaaaaacaactcccggcgtcccgaaaacaaagcgccttgcttgggctctccgaaacactgcccagcaaaactcgcgaaacgaaaaacaactcccggcgtccagaaaacaaagcgtcttgcttgggctctccgaaacactgcccagcaaaactcgcgaaacgaaaaacaactcccggcgtccagaaaacaaagcgtcttgcttgggccctacgaaacactgcccagcaaaactcgcgaaacgaaaaacaatcttctggcgtcccaaaaacaaaccgtcttgcttaggctctccgaaacactgcccagcaaaacgcgcgaaacgaaaaacaactcccggcgtcccgaaaacaaagcgccttgcttgggctctccgaaacactgcccagcaaaactcgcgaagcgaaaaacaactcccggcgtccagaaaacaaagcctgcgtttgattcctacaggaatacacccgattctgtttttgcacgggagatgcgtatcgtgcaaaaaaagttttcagttcaaaatttcaaaaaccttgcaaaaaagtgacaccatttctcgacgtttcatgcaaaaaaatggttttggcgaaaaaaaaaattatggaaaagttttttgcatagccgtgtaaaaaaaccgtgcaaggacagaatcgggtgtaaggcctttgtaaatttctacaagaattcctccagttattcagctatttacacaggggttccttccaatatccccctggattaaaaaaaatgctctagaagtttccccaaaagactttacagggattcctacacatgagctcgtttcatgcttataataacacatttttgtcgtggcaacgttacttttatgtaattttcaaacaaactgttaatagttcgtcactacaactgtcgacatgaacgcttattcctatttcatataatttaaatatacatatactttactgtttcgtcattgctaagaataacttttgacattatgaatgtcgacgcgttttttttttatcctttaccaatgtctattaatatagttttgccacgaaacaaaaaagtaaataaaagcaaaactagtattaagtagtgattttcctctcttatctatggatcgcatcgccctgactaatcaacacccttcccgtggtgattgtggagatgcagatgtattctcggtctctagaagcaacgatcattacacattaatattccttccccatctcaactgactgtaaggaattgaccgacgccgttattgataaataatctgagtgctgctaaaatgtgcacttcgagagtaagcggaaaatgccatcccttattaattgggatcgaagtgcaattcccatcagttccgatcaatcacggagtagtaaccattgacatgtacagtcagactatgttaagctaaatttaattgtgcacctaattcatttctgaacttgcttcacaatctaaatttattccttcgtctctcttttcatcctcgcagtatcaacaaggtcgcccccaaggtccgcaaggtgttgcagttgttccgtctgcgccagatcaacaacgccacgttcatcaagctgaacaaggccaccaagaacatgctgcgcattgccgagccgtacatcacctacggatacccgacgctgaaatcggtccgccatctgatctacaagcgtggattcgtgaagcaccgacacagccgcattccgatcaccgataacttcgtgattgagcgcaagctgcgcgccggatacaagatgcagtgcgtcgaggatctggtgtaccagatctacaccgccggacccctgttccgtaaggccaacaacttcctgtggccgttcaagctcaacaccccaaccggtggatggcgcaagaagaacaaccattacgtcgagggcggtgacttcggtaaccgtgaggataagatcaatgagcttatccagcgtatgatctaagttgagaccggttaggtggataaggttgcgagagagcgagttaaataaaacaacaaaatacctttaaaaattgaatttatacgtgtaagcatatttgtttcttagcattttcttttcctgtgcctttggcatacgcatgcagataggtccgaagtccttgcggaagaaggttgggttaattatacgagtggcgtaaggtgacaattgtcgactcgagtgaagtgactcgccgtgcaaatctcgcgttgtgtatcatacaggcgtatttgcagtgatggtttttctctttgcattagtatacacgtaaataaaacgattttcgtaacattcaatgatgtagcatggcgaaggacgatgaatactttctattaatgggtctattcaacgagtggggtgacgtgagaattctcgactcgagtgtaatgcctctccttttgttttgcacggcgaatgcactcgtagaatgaacccaaatgtcacatagttgaatttctacgcacaccgtaaagtgccgtaattcagcgcagttatggaataacacgattcaaatgattaatttaaaatgactaatgcatcaacaaaaaagctttatgagtggatcgctagcaaatctgttgtagattatgggaaaaatataaactagactgcattcataatttacaatagggtaacgactgtttatttcgttcttaa

SEQ ID NO: 206 - DNA, 14953 bp, Aedes aegypti
  misc_feature (14514)..(14613): n is a, c, g, or t
cgatctatcatatttacctgccggtgaaatcgtaaattcacgctatactgcacttccggaagaaacttttacccgcatattattgaagcgatacgcgcactggattagtaaaacataaaatatttatctaacaatgcaatctcgagttctaacaataaaagctttcagcaaaattatctgattcacggagtgaaaaatgacagttgagtaataaaaagcatctatgcagtcgctaacgcacacatattttgtttcactgtaacacttattgtacatttactgtaataccatacatgttatcagtgtgtttgtggtatttcttcgtagccgtctacaacaagtaactgtaattgtaatatatgccaaattgttagattatttaaaggtttcaattgtgcattgtaaggaacttttcaaggatgttatcccgaacattgacataaactggtaatgtaaggttactgtgatatatggttttgaaatgaaatctgattacagtaaatccataaacgaacaataacacaaacagtgggcatatacaaaacagtaaacatgttgtttgaacaatgtggcaaattgtgtttttctatgcgggtattcatatgacaggtccgtatatgcatttgtttacatcttacattggtggaggaccagtgcaaacctgagacgtgcaaactacagtcactctatacacggagaaatatttttacctaattttttagtttactttacccaaaattaagtatattgattatagtttcaacccaaaatctctcgggtttttctttctcccacacgaatgttgtcaaaaaaagagagagctgcatctacccgatgggggtactttggcccaataagccaaatttgggtaaatgcaacttttcttatgtttgggtcgaaagaactcaattttgcgttaaatcaacccaaaattgagtatatttttctaatggaattaaaaccaaattacctagtggggaccttggaaatttagccaaaattgagttattgggctcaactacggaattgcgttgaaacaactcaaaattgagttgaattccgtctccgtgtaggcattttcatgtgacaggtccgtctatgcataggcctattcacatgacgtctcaaatcagctgatcgggaagcactttgacagttcttctatgaaaatgacaggcccgtgttagcaccggtcgtccaccgatgtaaacaaatgcatagacggatctgtcacatgaaaaggcctatttgttcacttcggtggaggaccggtacgaaaacaagcctgacattttcatagaagagcttgcaaagagcttctggatcagctgatttgaaacgtattgtgaaaaggcctattgacagtttggcgaatagaaaatcccaagaactgacaacataataatctcacttgaatcgctggcaactgaacaaaatgttcaagccttcgactgaccttcttgtttgaataatgacaaaataatattttccctcgatcaaccataataaaattcattaagaacccattcacatatttcataacgctgaagggggtaggtgggtgtcttcaagatgttacaggtcatacaaaatttgaaaaatattcttacaaaatgcgttatgagggagagggtgggtgttgaaaatgggcattttaggcgttatgaaacttgcaaataaacccaaggtcaaatttcgacgaatatttttgaactgcactttgctttatacaaatgaagcttcttttttttcctgtaatgcgaattatttcttgagcttttgttgatttaaatatatctgcggtcacaatattactcaccgattcaagcactctaccacagataacagttcccgcataattatgaaccatactggtactgtttctcatattgtccacaacaatttgaacccatatctgaacaatatcgtgaaccatgagtaataacaataaagcaacaatcacagaaacggttttgacagtttggcgaacggtaaatgagaaaataacaatgtgtgaaataggcggttaagttatgtaaccatttaaaaacgacgatggtagatatattatccattttttgaaaaattaattgtaaggcaaacagtttagaaacagtaaaaccataaaatcgtaattaaaataaataatgtttgagtaattattgatttactgcttcgcgactaaaaatgggtgaaccaacgtgcgaagttcgatttttgactaactttgccgcgtcgcgagtcacttcgatatagtgcgcatctatgccctccgccgtgtgcattatgcgcactattgagaattgaattgcgacgcggtgaagttggtcaaaaatcaaacatagttcactaatttgacttttgagcggtgccgaattcactggtttccatggtcacatatataacacggcaccgctcaaacgtcagataatgaactcgtgcataggtccattctcttcttgctggaagttgcagcgtgacgtccagaggactgacatggctgtcatcctgcatatatttcggctcttcctcacatcgtttttggtacttcgcgttttgatacccactttctggtcggtttgccctaaccttcacctgattttcgagtatacgtctaatgtgctgctagtgctagtttctggcaattaaatatattgcgttaaatcgttgttattgatggcgctttttcctgtttcaacattttgttgaatgttttacgcatcagtaaggcatcattgatgtctcctatccaaaaaatcatatgttttgtcagtctcaaaagaatcaaaacaaaaacactggacgccatgttgaatcaatgttggatagctaattatggatcaatgcatgagttcactaatttgacttttgagcggtgccgaattcactggtttccatggtcacatatataacacggcaccgctcaaacgtcagatagtgaactcgtgcatcggtccattggctcatttcacccccctggtgacgtcatcgtaaattagttcattgcgctcctatgatatttaacgctagatttagatcgcattcagtactgtcagccaactgtcagttgaaagtaccaaaacgtcgtcttctctcgctgcattcatcaatcaggacccttcttaactgctgcgtgcatcattttgctcacgtttttcgggaaaggaaattcacgtaaatgttcggttatttctgcggtattatttgcgatttcagctaattagaacccatcagccctttggccaacccgcagcggaccatggatgaagaggatgaccccgtgattgaagaggtaattgaaggaagatttttgatgcgatggcactcttgcttactgtttggatgttctctcttccggcgacaatgcagattccagtttatctgtccaagaccctggcggagaacctgtacgtgctgcaatatccggtgaaatcttccgcatcgacgtttgacgatggccaagtggtgaactgttgcgtgaagcccatcaaccaacaggtaaagaccggattggaacatgtgcaatctgtttacttgaatcttttgcgtagtgactcaaattcatattcgtacagggctctgattttccatcaacttgatataaaattataaaatatatatatcgaatccatgagtaggacaatcgttggcaagcacatcaagcccaacgaagctaagacagttttaaatctgaagagatcctgttcacaggtctggtagaaggtttcttattagagacttgatttctattccaaagcatgtctctaaaaaggctcttttagatcaaaatggtcgcttttcctttttacacttgcagtgaatcctgttgccagattttagagatttctgaaaaacctttagaaactattaagcgactatttcaagggttcttcaggaatttcctcttagattcctcgaggaaaggcttcaggtattctgctagtgatttattcaaagatttcttctgtcctactttcatggactccacatatctctccagagatttctgaaaaatgtgtgcgaagatttccttgggaaatttcttgaaggaatcttaacaggaatctctgaagttattcctgaagtgattttactgatgatgtatgagcccagtttagtggaacagatttagatattaagtccagaataaatatatggctcaacaaccgttgagctttgtctagtttgcttatttattttcaatatgtaaaaaataattattgataggtaccttgctgtgaatttctgttttttctttcttttttttgcagaattttgaaattaaatgaagtgaaatgataaaatgtagcgatttctaaagaaactttacatggcttaccgaagtaaacttattttccttgagaaatctgcgtaatacacgaagtagatatgggccaatcgcaagattttcagaaaaaaaaaatgttaaatatatttgaaaaacgatcaaatagttcacttaagcatagctctgacaaaaaaaaactctttcatgcgtctctacagtgattctacagcaatctaaagaaatcactgaataacttgttcagggatgcataggggaatgtggggcaagatgagcacccggggcaagatgggcacccctagtttgtgtcgttcctaccgattttttttcaatacattatttggggttccgatgaatatcattaaattgatatgatggtcataaatttcagctaaaaaatcaacagcacaacgtaaatattgtccaaaatacatagaagtccataaattaaccatataagatttgttcatttaaaagtgatattttcgttgcgtaagcaaattaattcatacgtttttggccgtatagttatagaataatcttctgtagataatcaggagcaaaactttttatcaaatttaaaaaatatttcaattgttttgattatattaataaatttacacccttggggcaagatgagcaccatgtttaaaattaagtaaaagtgtgaaattatagaaccacatttagctgtgagcttgacttacggtatcttctttgcacaaaacaatttttctaaaaaatatacaaacaaacaacaaatttaatcgttttttaagtaaaatcttagcaatttatgaaaagttatttattttctgataaaagtttcaaaaactaagctagttgaaaataaatattatcagatattaaagataaagatcttgggatattgcaagcattgaataataatagttttctttagtaaattgcatctttttatgggggtgcccatcttgccccgcagtttttttgaccgatgataaaaaagctattttttaaagtgttatttggaaaactatttatttatttatttatttatttattaaatttatcaacaggcttcgtagccccaatgatattgttaaaactaaggacagcaatacaaattaaaaaaaaactcaatcacgaacataatcttggtcacagtctcaaacataatcataaactttgtcaggcaattaaaaaaaaacatttaacatataatcgttgtcgttatccgcttctaccagcaaaaaactccgaaaatcttcgacgaagcgattcacgggtgaggtggaagtcaaatagtagggcaatcctgttgaagacgcgctggataccgatgatcgccccatgcattccgtagttagttcttcgtaatggcaagcgtagtataacattgttccggagtgatcgtgactgggcgtgtaaatcaattttttccaggatgaaggcacaatctatccgtccttgtagcgtgtctgcaaccgtaagagctctgcagacgtcccttctggtgcgaagtagctctagatcaatcagctggcatcgactctcgtagcttggcagttggaacgggtttctccatggcagtttccgaagtgcaaaccgaagaaagcggtgttgtacggactcaatcctttcggagccgttgtcgtaagcggggctccagaccgcagaacagtattccaaagtggaacgcacgagcgagcaatatagggactttaagcagtagacgtctgtgaagttctttgcaatcctgaagatgaatcccaatgttctggatgccttgtcgacaatgtacgaaacatgcggcttgaatgtcagctttgaatccagaatcaccccgagatcctttacttggttcacacgatcgattgtagttcccagcaggcagtagtcaaatattatcggctgtcttttccttgtaaacgttatgatcactttttaaaacttttaatggttggaggtcaaagtaataatgtaaaagataaggatggttaccaattttgccaaaataattacgtttaagtaggcttaaatcgcgcttatccttagggtgctcatcttgccccgcctgaccctacaggaacaccatgagtgattaatcctatattactttcaataatgagtattccagtaatgtatcaaacactgcttccttaaatcattatttataggatagcctgtagaaatttgataacaattacttgggaaactatcctgagattcctccagtaatgtcttgaggaattgtaacattgtaagaaggaggtgatcaatagttcaacatcaaaagttattaaaacaagtttttgttaatccaatctttttttttgttgaaaaaactattgactgtactatttaggtattttcgtacgcaagatctgttctactcacttcttgcgctaacaatgatgaaggccatacgtgtcatctattgctcgggctttgcttttaagctcgtgagcgggctactggaacatgagcgggtactggtacgttgacggtatttcgactaccacttgcagtcttcttcagtgtcagttactcgtatccatctagaatgcttgtgtctttagcaaagttgttaagaaacttgaaagcagattgagaaagcaatgtttagttagcaattttgccgatacgtggcgctagtgtgcatgtaatttacatgaccaaattgcaggttttagctcatgataccgactacttagaaagttcgtgtctccagcaaagttgttcagaagcttggtaactatttgaggcagcactgtttggttggaaagtttgctgctacatgacgttagtgtgcatgcaatttgttcacattctagctcatgattccaacctcttagaaagtttgtgttttcagcatagttgttcagaagcttgaatacaatttgaggcagcactgttttgttagcaattttgctgctccatttcgcttattttcatgtgaatacaatgtattttagaaggttttaggtgactcagggatagtaccacccaccatatatatgtaatcactccatcaagtattgtaacgcttcatttgaatattttctacacccattaacaatcaagcatcactttcctaactacgatgacatacctcaaagcattcataatttgcaatgttctggttttcaacaaacttgaccagaattttttattcgattaaaatgtataatgtgtaatttaagcgcttttcaagctgttttatgttatgatcttcaccacctagatctagaagaataatgtcttcatcatagttatttagtgtaccggaaacaaaccaatgttgcgcgattggttttaaaattgtaatacagtcaactttcgttcgttgcactaaacctgtagcccacttagtgaaagactttcactaatccggctgagtttcgagctgttaaatagcatagaacataagaaaaacaggggcccagatagccgtagcggtaaacgggcagctatttagcatgaccatgctgagggtcgtgggttcgaattccgctggtcgaggatcttttcgtaaaggaaattttctcgattcccagggcagagagtatcttcgtacctgccacacgatatacacatgcaaaaatggtcaatcggcaaagaaagctctcggttaataactgtggaagtgctcataagaacaccaatctgagaagcagactttgtcccagttgggacgtaacgccagaaagaagaagaagaataagaaaacagaactatcaacattgataaattgcgtcttgggctacagggtgtccgcaaattatccgtacaaactttgaagacctggctctatacaatcaagcataataaattcaatattcttgcatggttttaaacattggcttattatattcttaagaaataagtttgacacatttccgatttcaaataattgcaaaaccaacccaaatgtattgacgtgtattaaagggagctgttttccgagctttatgacggaagagaaatgtccatagtactcactggatttgaaccgtacaattttctatttccagtgtaacttgaagccactaacctgtagattacttcaaataataataggacatttggattcatctcctttaggttttagggataacacatccccagtatgactagcggccctcaggaaaaacgtcttcgaaaaatttaaatttgcctatctcagtaacaagcaatcatttcgaaattttttaaagttgtattttgtgttaacatatagatgtattataaaaggtacatggacattgatttttcattgttttcaatgtgagatcatctttccaatattttgctgttcggataatttgcggacaccctgtatagcccatctaacgggagcccaattaaaacgtagcccactaaaaaatagtgaaacgaacaaaattcgactgtactggcaatcgttttgagaaaaataacaatatatttgaatgaaaatatttttgaagtacgaaaattgaaaaacaagttatttttctaaggcttgtacacttagtcaaaattttaaacttggcggaatataatataatacaatattaaataatattatgtttttgtttgttttcaaaaaaatcaaatatcaaaattgcttaccaaacagtgctgactcaaattgcttctgaacattttttctgaagacatgatcatgctatgtggcctggataatgagctagaacctgctagaatgtgaccaaatttacacgcacactagcgtcacgcagcattaacgatcaacgctccgtcatcgtaatcatcgtcatcatcgaaacttcaaaagcagtttttctgttcaaaactaaaaattattcgatgaaaatgtgttcactgtgtttcggttgaagatcagagtacagtgaacatattttcctctaaattttgttgatttttaatgaaaaaactgcttttgaaatttccgaaatcaatgacggatcctgcccccttaaccttcgggctgtcgcgctgttgtactttgtacaacagttgtgatttatatgctatcattttgcaacaaagatatctatcgacaccaaaccaaaatgtattcctcaagaatcttcttaagaacaatattcaacggtttttatttacagtatgacccttgataatgcggtaaaaccaaaatatatacatgaaagtcgcataataatgaacgtaatatatacggttcgagtaaaccacagttttaaatcggtatatctcaaaatccagataatatagaaacttggggtctttagtaaagttgttctggcggtgaagcgctatctgatggtaccgcattcaattcggaatttgaccgctaggtggcactagtggacatggaaattttacttttgttttgcaaatatttcaggatcctgatcattcagaaggatggcgtcttcggcaaagttgtttagtaagttaagcactatcattgttcgagctagttgattcaaaattttgcctcaaggcggcgctagtgtgcatgaaacttttgtttgcagatatctcaggagcctgaccacttagagagatagtgtcttcaacaaagtagttcagtagctcaaggactatcattatttgaggtaagaaataggatattttgccaccaggcggcggtagtgagcataaaatttttgttttgcggatactgcaggatcttgactttttagacaggcaccttcagcaaagttgttcagaagctcaggaactaccattattttacaaaatctcgagctctaaggattaaacaaagaaataatttgaactactgaacaactatgccgaagacgccatctttctaagtgatcaggctcctgagatatttgcgaaacaaatgttttatgctcactagtgccgcctggtggcaaaattttgaatcaattagctctaacaatgatagtccataagttaccgagcaactttgccgaagacgccatctttctaagtggtaaggatcctgagatctgcaatacaaaagttttagctcactagcgccaagtggcaaaatcccgaatttcttggctaaaataatgatagtccttgagctactgaacaactttgccgaagacgtcatctttctaagtagtcagactcttgggatattcgcaaaaccaagggtgttgtacaaagtacaacgcgcgactactcgcgttacaaaaattcgcgcgacgaccgaaaggttaaaataataaccaaacagtgctgctttaaattgctttcaaatttccgaaaaactttgctaaggcctcagtgaagtataacccagcatagagcatacaaaataaagcattctgtatgattccttagcgtcatcggaagcccttaacttttgaatggtgcgtaaagaatacgtttccgcaacttgaataattttaagtaaatcaaaatgtgtggccttttcatgattctcattccggacgcttcctcacttttgcctcatattccggacattttgattcgaattccggacagctcatgataatcaataatggaacagtcaaaccaaatcaaattgaaatcgtcaaaccactaaagagacatctaaggtaggtagttgtgcattataaattttcaaagatatttatggaaaaagcttactaaaacgagcctcgaaattgagaatttttgaacggcaaaattgaaacatttcgtgtgaaatgtttcccatacaaagtagagtgtccggaatttgaagcttcccgtaatatgaatcaaaacggtacattactgtggcgctatcagcaaaattgctaaccaacaaagctgcctcaaattgttacttgacagtgaaatctttgcccaagacacgaactttctaggtggccagaatcatgaactagagtctgctagaatatgatcaaatttacatgcacactagtgcaacgtagtgggaaaattgctaactaaacagtgctgtctcaaattgctttcaagtttcttatcaactttgctgaagacacgaactttctaggtgatcgggctcatgagctaaagcctgctagactatgatcaaactaaatgcacgttagcgccacgtagcggcaaaattacgcattaaaaattccacattatgaacgccataaggcttctggacaactttgctgaagaccgcaactttgtagaaagtaaggattccgatatagcttcataaatattatagttttaagtgatgctaaactttttggggctgctgcaatattcaactggggtgttgcaatactaggtgatgcgattccatacatatggtgggtggtgtaagtgcaacatcaattcctctccttgcccagcacttacacactgaggatatttatattgaaagacagctcctatcacacaatgcacaatcctctggacaaatcaagcatttcagatgaatgtacatcgactttcggcgcttctttaacttgccaaatttgatagagaagttcaatccccatcgaaaaattcaatgctccacgtgtccttaagaccatgtttgacggtatatcatttgctcgtttttaccaccttgatgtcctgtcacggtcgccatgtactaaaattcttggcagggctttctttaaataatcctgttagggacgtttttatcgggagcaatggaaacctctagcagcttagatttccagcagcttcaagactgtaattttatttaacaattttcttaacgatagttcatataatatattaattttacttacatttaagtttcacggctttaactccgagatacgtttctcttaaccttaaattatcaattacataattcactttataattttactatatgaataagcagctataactatcatagcttgaccgttcgactgttttatgtcatcatattctaaatagaccaaagcgaatccttactccaaaagttgcgattttggaatgaatttattatatcgttcgattagttcgagacccataagggcccattcacaaatttcataacgctgaaaggggtgggtgggtgtctctaagatgttacagctcatagaaaaatatgaagaacactcttacaaaaagcgttacgagggggtgggtgggtgtctaaaatggccattttcggcgttatgaaatttgtgaatcaacccatagagaatgcaacacacgggtggtcagcaacttggcagtttggcagtttattggtttggaaaatacaatgttgcaaagacaacattgtcggtcaaaagttttgcaccacatgtgccctgtacgaatatgaaattgagcaactgtatttttttcgattttaggtgaaggtggattatgctttgaacacggcctccaagaactacgatgccttcaaaggcgagcagtttgcgatcgctgccgatggcaaggacaaggaccgccaacagaagcccagctttcggagcggaacgatggacaagcagtccttcctgagctcgaaacccatcgaagacgtaaatcggtatatggtttgtgtgctgcaggaccgggagatccacgccactccggtccggggcatcgtctcgatgcggcaggtgttttcctactttgacaagcaggacaagcggacaaaggcggaacagaaagccgaacaggacgccgatgccgatgaggaagagctcaaacaggtcacggtcaaattcgctcgaaccgagaacgaaaaggtgcgaaaagccagggagaaatcgttcaactacatctcgaagatggaatcggaagaaccgtggtgcgaaacgttctggcatgccaagaagtccaccacggcggaactggagcggcacaaactgttctgtagttctgcatcagcagcttcctccagagacggggcggagagcgccctcaacgtggggaccgccgagtatctggacatgctgattagcaaggaaaaaaccgataggaatatagattctatgctgccaagccgggtcgtctgcatgcacaagctgaagcaaatggcgctcgtcgatcagattaaggttattcttaaggatggtaagttttgtcaactatcggggctaccaacaggtgacgctgaacatctgtaataaatatatcacatttggattattatttcgttctagcaaaagttctcacgttccagcagatcatggaactcctcccggacaggacactaccggcggacaaagtcctcaggtcgctcccgctggccggcgttctgatccgtggcaactgggtagtccaatcggagatcatctacccggagggtagcgtttccagcacgaacggagtgccggccgagcagatgtgcaaagcacgggattacattctgttcaggtttacccagtgcgacaagctggaacgtcatcagctggcctttattacccagctgccgtcggaggagatccgcgagatcctgtgctcggttgcgaagctgaacagtgatcggacgtggagtttactgctgccaccaaatgaagatttctctgcgaacgagcaggaaatcagtgatagacagaacgctttctggaccgcccgggcggacaagttcaacgaaatggagaaatcgaccaaacgggtgcggaaaaagtcctctcgatcggaaagcaagtacgacgtcaagatgagcaatggctagtagaagactgcaaggagtttcgttatgaaccaatctacaacgttacgatgcgaattaggtacgcaagactatttataattatcgaaattacaagtatatttaagaaattctgtatgctctaagccttgttaccaatcatccgaacggttgcctccagaatgtcccgatggatctggtcccggttggtttgggtcacgtgaaatagctgagcatttctgatccgcttcaaacgatccacgatgttcagtgtggctttgaggggaatcgtggccacgaagcaaagatcgccccgttcgacgctatcggcgatttgtagcatgcgatcttcgaagaatcgggatttcagctccatttttccgatttcatccagaatcagcagatgggcggtacgggaacttagcgctggcagggccacggattcaaactccggaacgcagacggtgtatttgccgacacggttcctagccggagcgttcttcattgtttcgctgtttggtgtggaagaaattatttgggttaattccgatatatcaccttcatccaacttgacttgtagaacaagcacctgactcgggatagcggtgccttcttgccatcaaacgtgatgatgtcgaatcccgtgcgttcgccggtggcacttcgtagctcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgttttgttttcattaattacagctgtttgaaatttgaaaagccttaagtgcgcagagtatggggccttcacggtaccttatttaattcggaatttgactgctaggtagcactagtgggcaggcaacttctacttttgttatgcagatatctcaggagcctggccacttataaaaatggcgtcttcgacaaagttgttcagtagctcaagggttattattattttacctaatcttgaacgtcaaggcttaaacaatcataatcattgatttactgaacaactctgacgaagtcgccatctttccaagtggtcaggatcctggaatatccgcaaaacaa

SEQ ID NO: 207 - DNA, 21 bp, Aedes aegypti
tactatcaccttggttattgt

SEQ ID NO: 208 - DNA, 21 bp, Aedes aegypti
ccgtaaggccagcagtgtagt

SEQ ID NO: 209 - DNA, 21 bp, Aedes aegypti
ttgtatgctgaacctaataat

SEQ ID NO: 210 - DNA, 21 bp, Aedes aegypti
tccgtcaccgcgacgataatt

SEQ ID NO: 211 - DNA, 21 bp, Aedes aegypti
cactgcgcctgcggatcacat

SEQ ID NO: 212 - DNA, 21 bp, Aedes aegypti
gtcgtgctcggcgatcatgtt

SEQ ID NO: 213 - DNA, 21 bp, Aedes aegypti
ccgggagcagcggatcttgaa

SEQ ID NO: 214 - DNA, 21 bp, Aedes aegypti
tgctgagctggcgctggatgt

SEQ ID NO: 215 - DNA, 21 bp, Aedes aegypti
gtgatatggcgaattattaat

SEQ ID NO: 216 - DNA, 21 bp, Aedes aegypti
gcgttggcctcgctgttaact

SEQ ID NO: 217 - DNA, 21 bp, Aedes aegypti
caccgacgcgcaggttcaact

SEQ ID NO: 218 - DNA, 25 bp, Anopheles gambiae
gcctaatcaacctgatcgaccacaa

SEQ ID NO: 219 - DNA, 25 bp, Anopheles gambiae
ggatgcacgaatcttcgatgatatg

SEQ ID NO: 220 - DNA, 25 bp, Anopheles gambiae
gtaggattatgaactcgcaagatca

SEQ ID NO: 221 - DNA, 25 bp, Anopheles gambiae
ccagcaccagccaacgaggaacact

SEQ ID NO: 222 - DNA, 25 bp, Anopheles gambiae
catcgagcgtgaacgcaaacttgca

SEQ ID NO: 223 - DNA, 25 bp, Anopheles gambiae
ggtggactattacgggcaactttgg

SEQ ID NO: 224 - DNA, 25 bp, Anopheles gambiae
gtggtggactattacgggcaacttt

SEQ ID NO: 225 - DNA, 25 bp, Anopheles gambiae
gcagtggtcaaatcgttttaatagc

SEQ ID NO: 226 - DNA, 25 bp, Anopheles gambiae
cgaatcttgaaaacgattaccgctg

SEQ ID NO: 227 - DNA, 25 bp, Anopheles gambiae
attactccatcaagagcgacatcta

SEQ ID NO: 228 - DNA, 25 bp, Anopheles gambiae
ggacaaagatctgcagtatctgcat

SEQ ID NO: 229 - DNA, 25 bp, Anopheles gambiae
cggtacagtttcactgcgtggcgac

SEQ ID NO: 230 - DNA, 25 bp, Anopheles gambiae
cctccatctcgatgctgtatctgaa

SEQ ID NO: 231 - DNA, 25 bp, Anopheles gambiae
caggtgatggtgtacgacatcgtgc

SEQ ID NO: 232 - DNA, 25 bp, Anopheles gambiae
atcctaaaacgctagtcgagataga

SEQ ID NO: 233 - DNA, 25 bp, Anopheles gambiae
atgaacagtatttcgctgaaggaga

SEQ ID NO: 234 - DNA, 25 bp, Anopheles gambiae
caataacaatcacaacggtctgaac

SEQ ID NO: 235 - DNA, 25 bp, Anopheles gambiae
ggttgaatgtgcaggcgatcaacct

SEQ ID NO: 236 - DNA, 25 bp, Anopheles gambiae
agattaaggaatcgattgagcaggc

SEQ ID NO: 237 - DNA, 25 bp, Anopheles gambiae
gcaggtaacggacgaggaagattca

SEQ ID NO: 238 - DNA, 25 bp, Anopheles gambiae
gaagaaggatgttacgaatgtgcta

SEQ ID NO: 239 - DNA, 25 bp, Anopheles gambiae
ggaagatgtttaatatcgtcgacaa

SEQ ID NO: 240 - DNA, 25 bp, Anopheles gambiae
gggagtggttgcatgcgaatcacaa

SEQ ID NO: 241 - DNA, 25 bp, Anopheles gambiae
cgatgagcaagtaaacgaactgatc

SEQ ID NO: 242 - DNA, 25 bp, Anopheles gambiae
gcagtggtcaaatcgttttaatagc

SEQ ID NO: 243 - DNA, 25 bp, Anopheles gambiae
cgaatcttgaaaacgattaccgctg

SEQ ID NO: 244 - DNA, 25 bp, Anopheles gambiae
catcgagcgtgaacgcaaacttgca

SEQ ID NO: 245 - DNA, 25 bp, Anopheles gambiae
cgctgcaggaagcgaacaacattat

SEQ ID NO: 246 - DNA, 25 bp, Anopheles gambiae
gctcgatcagctattacgaactgaa

SEQ ID NO: 247 - DNA, 21 bp, Aedes aegypti
ctcgatggggccccacgattt

SEQ ID NO: 248 - DNA, 21 bp, Aedes aegypti
tgctgcggtcgcagattgatt

SEQ ID NO: 249 - DNA, 21 bp, Aedes aegypti
atggcaccaggcgtgatagtt

SEQ ID NO: 250 - DNA, 21 bp, Aedes aegypti
atccggagccggttttgttta

SEQ ID NO: 251 - DNA, 21 bp, Aedes aegypti
gccggagcgcctcgatgcagt

SEQ ID NO: 252 - DNA, 21 bp, Aedes aegypti
cggcttcgtcggcgaaacgtt

SEQ ID NO: 253 - DNA, 21 bp, Aedes aegypti
ttgaaccggttgcatgaaatt

SEQ ID NO: 254 - DNA, 21 bp, Aedes aegypti
gggcgagcggggcgaatgcat

SEQ ID NO: 255 - DNA, 21 bp, Aedes aegypti
tgcctcgagcggtgttgtact

SEQ ID NO: 256 - DNA, 21 bp, Aedes aegypti
atgtagtcgatgatatttaca

SEQ ID NO: 257 - DNA, 21 bp, Aedes aegypti
cagtcgctgcccgtttggttt

SEQ ID NO: 258 - DNA, 21 bp, Aedes aegypti
accgaacccgcggctacgctt

SEQ ID NO: 259 - DNA, 21 bp, Aedes aegypti
acggggccagggcggtgattt

SEQ ID NO: 260 - DNA, 21 bp, Aedes aegypti
gtcgaccacgctggtaaaggt

SEQ ID NO: 261 - DNA, 21 bp, Aedes aegypti
aaggaatgattgcgattatat

SEQ ID NO: 262 - DNA, 21 bp, Aedes aegypti
ttgcttgttcgcctaattcat

SEQ ID NO: 263 - DNA, 21 bp, Aedes aegypti
tccgtgcaccggcgtcacatt

SEQ ID NO: 264 - DNA, 21 bp, Aedes aegypti
tcgctccgcatcgctactatt

SEQ ID NO: 265 - DNA, 21 bp, Aedes aegypti
tcccaacgcaaggtatgatta

SEQ ID NO: 266 - DNA, 21 bp, Aedes aegypti
ccgtcaccgcgacgataatta

SEQ ID NO: 267 - DNA, 21 bp, Aedes aegypti
cgctccgcatcgctactatta

SEQ ID NO: 268 - DNA, 21 bp, Aedes aegypti
atcgctcggcagcgttggaat

SEQ ID NO: 269 - DNA, 21 bp, Aedes aegypti
aacggcaggcaccttcataat

SEQ ID NO: 270 - DNA, 21 bp, Aedes aegypti
atccgtcaccgcgacgataat

SEQ ID NO: 271 - DNA, 21 bp, Aedes aegypti
ctgggccagcgccttcatgat

SEQ ID NO: 272 - DNA, 21 bp, Aedes aegypti
tgcagaacgcggcgatgatat

SEQ ID NO: 273 - DNA, 21 bp, Aedes aegypti
tcgaatgcctagataatttaa

SEQ ID NO: 274 - DNA, 21 bp, Aedes aegypti
ggctttcctgggcggagatct

SEQ ID NO: 275 - DNA, 21 bp, Aedes aegypti
tacgctgcaggcaggatttgt
